(12) United States Patent
Park

(10) Patent No.: US 11,898,211 B2
(45) Date of Patent: *Feb. 13, 2024

(54) BIOSENSORS FOR DETECTING AND/OR NEUTRALIZING BIOAVAILABLE URANIUM AND RELATED U-SENSITIVE GENETIC MOLECULAR COMPONENTS, GENE CASSETTES, VECTORS, GENETIC CIRCUITS, COMPOSITIONS, METHODS AND SYSTEMS

(71) Applicant: LAWRENCE LIVERMORE NATIONAL SECURITY, LLC, Livermore, CA (US)

(72) Inventor: Dan Mcfarland Park, Dublin, CA (US)

(73) Assignee: LAWRENCE LIVERMORE NATIONAL SECURITY, LLC, Livermore, CA (US)

( * ) Notice: Subject to any disclaimer, the term of this patent is extended or adjusted under 35 U.S.C. 154(b) by 831 days.

This patent is subject to a terminal disclaimer.

(21) Appl. No.: 16/781,950

(22) Filed: Feb. 4, 2020

(65) Prior Publication Data
US 2020/0248277 A1  Aug. 6, 2020

Related U.S. Application Data

(60) Provisional application No. 62/801,077, filed on Feb. 4, 2019.

(51) Int. Cl.
| | | |
|---|---|---|
| C12Q 1/6897 | (2018.01) | |
| C12N 1/20 | (2006.01) | |
| C12N 15/52 | (2006.01) | |
| C12N 9/12 | (2006.01) | |
| C12N 15/63 | (2006.01) | |
| G21F 9/18 | (2006.01) | |
| G21F 9/30 | (2006.01) | |
| C12N 15/74 | (2006.01) | |

(52) U.S. Cl.
CPC ............ *C12Q 1/6897* (2013.01); *C12N 1/20* (2013.01); *C12N 9/12* (2013.01); *C12N 15/52* (2013.01); *C12N 15/635* (2013.01); *C12N 15/74* (2013.01); *C12Y 207/13003* (2013.01); *G21F 9/18* (2013.01); *G21F 9/30* (2013.01); *C12N 2830/002* (2013.01); *C12N 2830/55* (2013.01); *C12N 2840/002* (2013.01); *C12N 2840/105* (2013.01); *G01N 2520/00* (2013.01)

(58) Field of Classification Search
None
See application file for complete search history.

(56) References Cited

U.S. PATENT DOCUMENTS

| | | | |
|---|---|---|---|
| 8,697,388 B2 | 4/2014 | Hillson et al. | |
| 9,580,713 B2 | 2/2017 | Breaker et al. | |
| 11,608,536 B2 * | 3/2023 | Park | C12Q 1/485 |
| 2005/0114923 A1 | 5/2005 | Blaylock et al. | |
| 2011/0117590 A1 | 5/2011 | Hillson et al. | |
| 2020/0370135 A1 | 11/2020 | Park et al. | |

FOREIGN PATENT DOCUMENTS

WO    2019/099934 A2    5/2019

OTHER PUBLICATIONS

Bailey, T.L. and C. Elkan, Fitting a mixture model by expectation maximization to discover motifs in biopolymers. Proc Int Conf Intell Syst Mol Biol, 1994. 2: p. 28-36.
Goodrich, R., Lorega, G., LLNL Livermore Site and Site 300 Environmental Restoration Project Standard Operating Procedures (SOPs). Lawrence Livermore National Laboratory Livermore, Calif, 2016. (UCRL-MA-109115 Rev. 15). 694 pages.
Hallberg, Z.R., et al., Engineering and In Vivo Applications of Riboswitches. Annu Rev Biochem, 2017. 86: p. 515-539.
Hierlemann, A., et al., Microfabrication techniques for chemical/biosensors. Proceedings of the IEEE, 2003. 91(6): p. 839-863. 25 Pages.
International Preliminary Report on Patentability for International application No. PCT/US2018/061667 filed on Nov. 16, 2018. dated May 19, 2020. 9 pages.
International Search Report and Written Opinion for International Appln No. PCT/US2020/016654 filed on Feb. 4, 2020 in the name of Lawrence Livermore National Security, LLC. dated Jun. 12, 2020. 14 pages.
McGrath, P.T., et al., High-throughput identification of transcription start sites, conserved promoter motifs and predicted regulons. Nat Biotechnol, 2007. 25(5): p. 584-92.
Siuda, W. and R. Chrost, Utilization of selected dissolved organic phosphorus compounds by bacteria in lake water under non-limiting orthophosphate conditions. Polish Journal of Environmental Studies, 2001. 10(6): p. 475-484.
Restriction Requirement issued for U.S. Appl. No. 16/764,824, filed May 15, 2020, on behalf of Lawrence Livermore National Security, LLC. dated Jul. 27, 2022. 8 Pages.
Notice of Allowance issued for U.S. Appl. No. 16/764,824, filed May 15, 2020, on behalf of Lawrence Livermore National Security, LLC. dated Nov. 2, 2022. 26 Pages.
Record for GenBank Accession No. AE005992.1, Caulobacter crescentus CB15, section 318 to 359 of the complete genome, 2002. 7 pages.
Andersen, J.B., et al., New unstable variants of green fluorescent protein for studies of transient gene expression in bacteria. Appl Environ Microbiol, 1998. 64(6): p. 2240-6.
Anderson, R.T., et al., Stimulating the in situ activity of *Geobacter* species to remove uranium from the groundwater of a uranium-contaminated aquifer. Applied and environmental microbiology, 2003. 69(10): p. 5884-5891.

(Continued)

Primary Examiner — Christian L Fronda
(74) Attorney, Agent, or Firm — Steinfl + Bruno LLP

(57) ABSTRACT

$UO_2F_2$ biosensors, and related U-sensing and/or F-sensing genetic molecular components, genetic circuits, compositions, methods and systems are described, which in several embodiments can be used to detect and/or neutralize uranium and in particular bioavailable $UO_2F_2$.

40 Claims, 81 Drawing Sheets

Specification includes a Sequence Listing.

(56) References Cited

OTHER PUBLICATIONS

Arellano, B.H., et al., Identification of a dehydrogenase required for lactose metabolism in Caulobacter crescentus. Appl Environ Microbiol, 2010. 76(9): p. 3004-14.
Baker, J.L., et al., Widespread genetic switches and toxicity resistance proteins for fluoride. Science, 2012. 335(6065): p. 233-235.
Bargar, J.R., et al., Uranium redox transition pathways in acetate-amended sediments. Proceedings of the National Academy of Sciences, 2013. 110(12): p. 4506-4511.
Basnakova, G., et al., The use of *Escherichia coli* bearing a phoN gene for the removal of uranium and nickel from aqueous flows. Applied microbiology and biotechnology, 1998. 50(2): p. 266-272.
Beazley et al., "The effect of of pH and natural microbial phosphatase activity on the speciation of uraniumin subsurface soils". Geochemica et Cosmochimica Acta, 2011. 75(19): p. 5648-5663.
Begg, J.D., et al., Bioreduction behavior of U (VI) sorbed to sediments. Geomicrobiology Journal, 2011. 28(2): p. 160-171.
Belkin, S., et al., Remote detection of buried landmines using a bacterial sensor. Nat Biotechnol, 2017. 35(4): p. 308-310.
Bencheikh-Latmani, R. and J.O. Leckie, Association of uranyl with the cell wall of Pseudomonas flurescens inhibits metabolism. Geochimica et Cosmochimica Acta, 2003. 67(21): p. 4057-4066.
Bereza-Malcolm, L.T., G. Mann, and A.E. Franks, Environmental Sensing of Heavy Metals Through Whole Cell Microbial Biosensors: A Synthetic Biology Approach. ACS Synth Biol, 2014.
Bernier-Latmani et al., Non-uraninite products of microbial U (VI) reduction. Environmental science & technology, 2010. 44(24): p. 9456-9462.
Berset, Y., et al., Mechanistic Modeling of Genetic Circuits for ArsR Arsenic Regulation. ACS Synth Biol, 2017. 6(5): p. 862-874.
Beveridge, T. and R. Murray, Sites of metal deposition in the cell wall of Bacillus subtilis. Journal of bacteriology, 1980. 141(2): p. 876-887.
Blanco, A.G., et al., Tandem DNA Recognition by PhoB, a Two-Component Signal Transduction Transcriptional Activator. Structure, 2002. 10(5): p. 701-713.
Blondel, A. and H. Bedouelle, Engineering the quaternary structure of an exported protein with a leucine zipper. Protein Eng, 1991. 4(4): p. 457-61.
Bollmann, A., et al., Isolation and physiology of bacteria from contaminated subsurface sediments. Applied and environmental microbiology, 2010. 76(22): p. 7413-7419.
Bostick, W., et al., Sampling and characterization of aerosols formed in the atmospheric hydrolysis of UF/sub 6. 1983.
Breaker, R.R., New insight on the response of bacteria to fluoride. Caries Res, 2012. 46(1): p. 78-81.
Breaker, R.R., Riboswitches and the RNA world. Cold Spring Harb Perspect Biol, 2012. 4(2).
Brewster, R.C., et al., The transcription factor titration effect dictates level of gene expression. Cell, 2014. 156(6): p. 1312-23.
Britos, L., et al., Regulatory response to carbon starvation in Caulobacter crescentus. PLoS One, 2011. 6(4): p. e18179.
Brutinel et al., "Shutting happens: soluble flavin mediators of the extracellular electron transfer in Shewanella", Applied Microbiology and Biotechnology, 2012. 93(1): p. 41-48.
Buchler, N.E., U. Gerland, and T. Hwa, "On schemes of combinatorial transcription logic." Proceedings of the National Academy of Sciences, 2003. 100(9): p. 5136-5141.
Buffi, N., et al., An automated microreactor for semi-continuous biosensor measurements. Lab Chip, 2016. 16(8): p. 1383-92.
Buttner, D. and U. Bonas, Who comes first? How plant pathogenic bacteria orchestrate type III secretion. Current opinion in microbiology, 2006. 9(2): p. 193-200.
Cabantous et al., "A new protein-protein interaction sensor based on tripartite split-GFP association". Scientific reports, 2013.3: p. 2854.
Capra, E.J. and M.T. Laub, Evolution of two-component signal transduction systems. Annual review of microbiology, 2012. 66: p. 325-347.
Carey, M.F., C.L. Peterson, and S.T. Smale, The primer extension assay. Cold Spring Harbor Protocols, 2013. 2013(2): p. pdb. prot071902.
Cheng, P.-C., The contrast formation in optical microscopy, in Handbook of Biological Confocal Microscopy. 2006, Springer. p. 162-206.
Choppin, G., J. Liljenzin, and J. Rydberg, Behavior of Radionuclides in the Environment. Radiochemistry and Nuclear Chemistry, 1995. p. 753-788.
Choudhary, S. and P. Sar, Uranium biomineralization by a metal resistant Pseudomonas aeruginosa strain isolated from contaminated mine waste. J Hazard Mater, 2011. 186(1): p. 336-43.
Christen, B., et al., High-throughput identification of protein localization dependency networks. Proc Natl Acad Sci U S A, 2010. 107(10): p. 4681-6.
Cormack, B.P., R.H. Valdivia, and S. Falkow, FACS-optimized mutants of the green fluorescent protein (GFP). Gene, 1996. 173(1): p. 33-38.
Da Silva Neto, J.F., R.F. Lourenco, and M.V. Marques, Global transcriptional response of Caulobacter crescentus to iron availability. BMC Genomics, 2013. 14: p. 549.
Dai, C. and S. Choi, Technology and Applications of Microbial Biosensor. Open Journal of Applied Biosensor, 2013. 2(3).
Datsenko, K.A. and B.L. Wanner, One-step inactivation of chromosomal genes in *Escherichia coli* K-12 using PCR products. Proc Natl Acad Sci U S A, 2000. 97(12): p. 6640- 5.
Davis, J.A., et al., Approaches to surface complexation modeling of uranium (VI) adsorption on aquifer sediments. Geochimica et Cosmochimica Acta, 2004. 68(18): p. 3621-3641.
Dove, S.L. and A. Hochschild, Conversion of the w subunit of *Escherichia coli* RNA polymerase into a transcriptional activator or an activation target. Genes & development, 1998. 12(5): p. 745-754.
Dworkin M, F.S., Rosenberg E, Schleifer KH, Stackebrandt E, The Prokaryotes: Proteobacteria: Alpha and Beta Subclasses. 2006. 5: p. 15-18.
Evinger, M. and N. Agabian, Envelope-associated nucleoid from Caulobacter crescentus stalked and swarmer cells. J Bacteriol, 1977. 132(1): p. 294-301.
Ewing et al., "Environmental impact of the nuclear fuel cycle." Geological Society, London, Special Publications, 2004. 236(1); p. 7-23.
Ferla, M.P., et al., New rRNA gene-based phylogenies of the Alphaproteobacteria provide perspective on major groups, mitochondrial ancestry and phylogenetic instability. PLoS One, 2013. 8(12): p. e83383.
Fiebig, A., et al., Interaction specificity, toxicity and regulation of a paralogous set of ParE/RelE-family toxin-antitoxin systems. Mol Microbiol, 2010. 77(1): p. 236-51.
Finn, R.D., et al., The Pfam protein families database: towards a more sustainable future. Nucleic Acids Res, 2016. 44(D1): p. D279-85.
Fisher et al., Transcriptional analysis of the major surface array gene of *Caulobacter crescentus*. J bacterial, 1988. 170(10): p. 4706-13.
Focazio, M.J., et al., The Chemical Quality of Self-Supplied Domestic Well Water in the United States. Groundwater Monitoring & Remediation, 2006. 26(3): p. 92-104.
Folliard, T., et al., Ribo-attenuators: novel elements for reliable and modular riboswitch engineering. Sci Rep, 2017. 7(1): p. 4599.
Francis, A.J., et al., XPS and XANES studies of uranium reduction by *Clostridium* sp. Environmental science & technology, 1994. 28(4): p. 636-639.
Gadd, G.M., Biosorption: critical review of scientific rationale, environmental importance and significance for pollution treatment. Journal of Chemical Technology and Biotechnology, 2009. 84(1): p. 13-28.
Garst, A.D., A.L. Edwards, and R.T. Batey, Riboswitches: structures and mechanisms. Cold Spring Harb Perspect Biol, 2011. 3(6).
Hierlemann, A. and H. Baltes, CMOS-based chemical microsensors. Analyst, 2003. 128(1): p. 15-28.
Hillson, N.J., et al., Caulobacter crescentus as a whole-cell uranium biosensor. Applied and environmental microbiology, 2007. 73(23): p. 7615-7621.
Hoover, J., et al., Elevated Arsenic and Uranium Concentrations in Unregulated Water Sources on the Navajo Nation, USA. Exposure and Health, 2016: p. 1-12.

(56) References Cited

OTHER PUBLICATIONS

Hsi, C.-K.D. and D. Langmuir, Adsorption of uranyl onto ferric oxyhydroxides: application of the surface complexation site-binding model. Geochimica et Cosmochimica Acta, 1985. 49(9): p. 1931-1941.
Hu, P., et al., Whole-genome transcriptional analysis of heavy metal stresses in Caulobacter crescentus. Journal of bacteriology, 2005. 187(24): p. 8437-8449.
Hutcheson, S.W., et al., Enhancer-Binding Proteins HrpR and HrpS Interact to Regulate hrp-Encoded Type III Protein Secretion inPseudomonas syringae Strains. Journal of Bacteriology, 2001. 183(19): p. 5589-5598.
Hwang, I.Y., et al., Engineered probiotic *Escherichia coli* can eliminate and prevent Pseudomonas aeruginosa gut infection in animal models. Nature Communications, 2017. 8: p. 15028.
International Search Report for International Application No. PCT/US2018/061667 filed on Nov. 16, 2018 on behalf of Lawrence Livermore National Security, LLC. dated Jun. 26, 2019. 5 pages.
Istok, J., et al., In situ bioreduction of technetium and uranium in a nitrate-contaminated aquifer. Environmental Science & Technology, 2004. 38(2): p. 468-475.
Jin, Q., et al., Type III protein secretion in Pseudomonas syringae. Microbes and Infection, 2003. 5(4): p. 301-310.
Jonas, K., et al., Proteotoxic stress induces a cell-cycle arrest by stimulating Lon to degrade the replication initiator DnaA. Cell, 2013. 154(3): p. 623-36.
Kabessa, Y., et al., Standoff detection of explosives and buried landmines using fluorescent bacterial sensor cells. Biosensors and Bioelectronics, 2016. 79: p. 784-788.
Karlin, S. and S.F. Altschul, Applications and statistics for multiple high-scoring segments in molecular sequences. Proceedings of the National Academy of Sciences, 1993. 90(12): p. 5873-5877.
Karlin, S. and S.F. Altschul, Methods for assessing the statistical significance of molecular sequence features by using general scoring schemes. Proceedings of the National Academy of Sciences, 1990. 87(6): p. 2264-2268.
Kazy, S.K., S.F. D'Souza, and P. Sar, Uranium and thorium sequestration by a *Pseudomonas* sp.: mechanism and chemical characterization. J Hazard Mater, 2009. 163(1): p. 65-72.
Kemp, R.S., Environmental Detection of Clandestine Nuclear Weapon Programs. Annual Review of Earth and Planetary Sciences, 2016. 44(1): p. 17-35.
Kemp, R.S., Initial Analysis of the Detectability of UO2F2 Aerosols Produced by UF6 Released from Uranium Conversion Plants. Science & Global Security, 2008. 16(3): p. 115-125.
King, J.M., et al., Rapid, sensitive bioluminescent reporter technology for naphthalene exposure and biodegradation. Science, 1990. 249(4970): p. 778-81.
Kips, R.S. and M.J. Kristo, Investigation of chemical changes in uranium oxyfluoride particles using secondary ion mass spectrometry. Journal of Radioanalytical and Nuclear Chemistry, 2009. 282(3): p. 1031.
Ko, W.-h. and F.K. Flora, Production of phospholipases by soil microorganisms. Soil Science, 1970. 110(5): p. 355-358.
Koch-Steindl, H. and G. Prohl, Considerations on the behaviour of long-lived radionuclides in the soil. Radiation and environmental biophysics, 2001. 40(2): p. 93-104.
Ku et al., "Notes on the use of propagation of error formulas". Journal of Research of the National Bureau of Standards, 1966. 70C, No. 4, pp. 263-273.
Langmuir, D., Uranium solution-mineral equilibria at low temperatures with applications to sedimentary ore deposits. Geochimica et Cosmochimica Acta, 1978. 42(6, Part A): p. 547-569.
Law, G.T., et al., Uranium redox cycling in sediment and biomineral systems. Geomicrobiology Journal, 2011. 28(5-6): p. 497-506.
Lim, B.L. et al. Distribution and diversity of phytate-mineralizing bacteria. The ISME journal, 2007. 1(4): p. 321.
Lovley, D.R. and E. Phillips, Reduction of uranium by Desulfovibrio desulfuricans. Applied and environmental microbiology, 1992. 58(3): p. 850-856.

Lovley, D.R., D.E. Holmes, and K.P. Nevin, Dissimilatory fe (iii) and mn (iv) reduction. Advances in microbial physiology, 2004. 49: p. 219-286.
Lovley, D.R., et al., *Geobacter metallireducens* gen. nov. sp. nov., a microorganism capable of coupling the complete oxidation of organic compounds to the reduction of iron and other metals. Archives of microbiology, 1993. 159(4): p. 336-344.
Lovley et al., "Microbial reduction of uranium". Nature, 1991. 350(6317). pp. 413-416.
Macaskie et al., Enzymically mediated bioprecipitation of uranium by a *Citrobacter* sp;: a concerted role for exocellular lipopolysaccharide and associated phosphatase in biomineral formation. Microbiology, 2000. 146(8): p. 1855-1867.
Macaskie, L.E., et al., Uranium Bioaccumulation by a *Citrobacter* sp. as a Result of Enzymically Mediated Growth of Polycrystalline HUO_2PO_4. Science, 1992: vol. 257, p. 782-784. 4 pages.
Malakooti, J., S.P. Wang, and B. Ely, a consensus promoter sequence for *Caulobacter crescentus* genes involved in biosynthetic and housekeeping functions. J Bacteriol, 1995. 177(15): p. 4372-6.
Markich, S.J., Uranium speciation and bioavailability in aquatic systems: an overview. The Scientific World Journal, 2002. 2: p. 707-729.
Marsili, E., et al., Shewanella secretes flavins that mediate extracellular electron transfer. Proceedings of the National Academy of Sciences, 2008. 105(10): p. 3968-3973.
Martinez, R.J., et al., Aerobic uranium (VI) bioprecipitation by metal-resistant bacteria isolated from radionuclide-and metal-contaminated subsurface soils. Environmental microbiology, 2007. 9(12): p. 3122-3133.
Mascher, T., J.D. Helmann, and G. Unden, Stimulus perception in bacterial signaltransducing histidine kinases. Microbiology and Molecular Biology Reviews, 2006. 70(4): p. 910-938.
Meisenzahl et al., Isolation and characterization of a xylose-dependent promoter from Caulobacter crescentus. J Bacteriol; 1997. 179(3): p. 592-600.
Modell, J.W., A.C. Hopkins, and M.T. Laub, A DNA damage checkpoint in Caulobacter crescentus inhibits cell division through a direct interaction with FtsW. Genes Dev, 2011. 25(12): p. 1328-43.
Myers, E.W. and W. Miller, Optimal alignments in linear space. Computer applications in the biosciences: CABIOS, 1988. 4(1): p. 11-17.
Myers, W.L., A literature review on the chemical and physical properties of uranyl fluoride ($UO_2F_2$). 1990: United States. 21 pages.
Needleman, S.B. and C.D. Wunsch, A general method applicable to the search for similarities in the amino acid sequence of two proteins. Journal of molecular biology, 1970. 48(3): p. 443-453.
Newsome et al., The biogeochemistry and bioremediation of uranium and other priority radionuclides. Chemical Geology, 2014. 363: p. 164-184.
Nguyen, A.W. and P.S. Daugherty, Evolutionary optimization of fluorescent proteins for intracellular FRET. Nature biotechnology, 2005. 23(3): p. 355-360.
Nolan, J. and K.A. Weber, Natural Uranium Contamination in Major U.S. Aquifers Linked to Nitrate. Environmental Science & Technology Letters, 2015. 2(8): p. 215-220.
Nomellini, J.F., et al., S-layer-mediated display of the immunoglobulin G-binding domain of streptococcal protein G on the surface of Caulobacter crescentus: development of an immunoactive reagent. Appl Environ Microbiol, 2007. 73(10): p. 3245-53.
Nriagu, J.O., "Lead orthophosphates. I. Solubility and hydrolysis of secondary lead orthophosphate." Inorganic Chemistry, 1972. 11(10): p. 2499-2503.
Pabalan, R.T., et al., Uranium (VI) sorption onto selected mineral surfaces: Key geochemical parameters. 1996, American Chemical Society, Washington, DC (United States). 99-130.
Pardoux, R., et al., Modulating uranium binding affinity in engineered calmodulin EFhand peptides: effect of phosphorylation. PLoS One, 2012. 7(8): p. e41922. 10 pages.
Park, D.M. and M.J. Taffet, Combinatorial Sensor Design in Caulobacter crescentus for Selective Environmental Uranium Detection. ACS Synth Biol, 2019. 8(4): p. 807-817.

(56) References Cited

OTHER PUBLICATIONS

Park, D.M. and P.J. Kiley, The influence of repressor DNA binding site architecture on transcriptional control. MBio, 2014. 5(5): p. e01684-14.
Park, D.M. and Y. Jiao, Modulation of medium pH by Caulobacter crescentus facilitates recovery from uranium-induced growth arrest. Applied and environmental microbiology, 2014. 80(18): p. 5680-5688.
Park, D.M., et al., Bioadsorption of Rare Earth Elements through Cell Surface Display of Lanthanide Binding Tags. Environ Sci Technol, 2016. 50(5): p. 2735-42.
Park et al., Identification of a U/Zn/Cu responsive global regulatory two-component system in Caulobacter crescentus. Mol Microbiol, 2017, 104[1], 46-64.
Park et al. "The UzcRS two-component system in Caulobacter crescentus integrates regulatory input from diverse auxiliary regulators", Molecular Microbiology, Mar. 2019. vol. 111, No. 3, pp. 678-699.
Park, M., S.L. Tsai, and W. Chen, Microbial biosensors: engineered microorganisms as the sensing machinery. Sensors (Basel), 2013. 13(5): p. 5777-95.
Pearson, W.R. and D.J. Lipman, Improved tools for biological sequence comparison. Proceedings of the National Academy of Sciences, 1988. 85(8): p. 2444-2448.
Periasamy, A., Fluorescence resonance energy transfer microscopy: a mini review. Journal of biomedical optics, 2001. 6(3): p. 287-291.
Poindexter, J.S., The caulobacters: ubiquitous unusual bacteria. Microbiological reviews, 1981. 45(1): p. 123-179.
Powers, L.G., et al., Introduction of a plasmid-encoded phoA gene for constitutive overproduction of alkaline phosphatase in three subsurface Pseudomonas isolates. FEMS microbiology ecology, 2002. 41(2): p. 115-123.
Procaccini, A., et al., Dissecting the specificity of protein-protein interaction in bacterial two-component signaling: orphans and crosstalks. PloS one, 2011. 6(5): p. e19729.
Ren, A., K.R. Rajashankar, and D.J. Patel, Fluoride ion encapsulation by Mg2+ ions and phosphates in a fluoride riboswitch. Nature, 2012. 486(7401): p. 85-9.
Renninger, N., et al., Uranyl precipitation by Pseudomonas aeruginosa via controlled polyphosphate metabolism. Appl Environ Microbiol, 2004. 70(12): p. 7404-12.
Richter, K., M. Schicklberger, and J. Gescher, Dissimilatory reduction of extracellular electron acceptors in anaerobic respiration. Applied and environmental microbiology, 2012. 78(4): p. 913-921.
Roggo, C. and J.R. van der Meer, Miniaturized and integrated whole cell living bacterial sensors in field applicable autonomous devices. Curr Opin Biotechnol, 2017. 45: p. 24-33.
Sanders, D., et al., Phosphorylation site of NtrC, a protein phosphatase whose covalent intermediate activates transcription. Journal of bacteriology, 1992. 174(15): p. 5117-5122.
Sanders, D.A., et al., Identification of the site of phosphorylation of the chemotaxis response regulator protein, CheY. Journal of Biological Chemistry, 1989. 264(36): p. 21770-21778.
Senko, J.M., et al., The effect of U (VI) bioreduction kinetics on subsequent reoxidation of biogenic U (IV). Geochimica et Cosmochimica Acta, 2007. 71(19): p. 4644-4654.
Sharma, C.M., et al., The primary transcriptome of the major human pathogen Helicobacter pylori. Nature, 2010. 464(7286): p. 250-255.
Shelobolina, E.S., et al., Isolation, characterization, and U (VI)-reducing potential of a facultatively anaerobic, acid-resistant Bacterium from Low-pH, nitrate-and U (VI)-contaminated subsurface sediment and description of *Salmonella subterranea* sp. nov. Applied and Environmental Microbiology, 2004. 70(5): p. 2959-2965.
Sheng, L. and J.B. Fein, Uranium adsorption by Shewanella oneidensis MR-1 as a function of dissolved inorganic carbon concentration. Chemical Geology, 2013. 358: p. 15-22.
Shin, J. and V. Noireaux, An *E. coli* cell-free expression toolbox: application to synthetic gene circuits and artificial cells. ACS Synth Biol, 2012. 1(1): p. 29-41.
Silva-Rocha, R. and V. de Lorenzo, Mining logic gates in prokaryotic transcriptional regulation networks. FEBS letters, 2008. 582(8): p. 1237-1244.
Skerker, J.M., et al., Two-component signal transduction pathways regulating growth and cell cycle progression in a bacterium: a system-level analysis. PLoS Biol, 2005. 3(10): p. e334. 1770-1788.
Smith, T.F. and M.S. Waterman, Comparison of biosequences. Advances in applied mathematics, 1981. 2(4): p. 482-489.
Stephens, C., et al., A cell cycle-regulated bacterial DNA methyltransferase is essential for viability. Proceedings of the National Academy of Sciences, 1996. 93(3): p. 1210-1214.
Stock, A.M., V.L. Robinson, and P.N. Goudreau, Two-component signal transduction. Annual review of biochemistry, 2000. 69(1): p. 183-215.
Stockbridge, R.B., et al., A family of fluoride-specific ion channels with dual-topology architecture. Elife, 2013. 2: p. e01084. 14 pages.
Stockbridge, R.B., et al., Fluoride resistance and transport by riboswitch-controlled CLC antiporters. Proc Natl Acad Sci U S A, 2012. 109(38): p. 15289-94.
Suzuki, Y., et al., Flavin mononucleotide mediated electron pathway for microbial U (VI) reduction. Physical Chemistry Chemical Physics, 2010. 12(34): p. 10081-10087.
Thomas, R.A. and L. Macaskie, Biodegradation of tributyl phosphate by naturally occurring microbial isolates and coupling to the removal of uranium from aqueous solution. Environmental science & technology, 1996. 30(7): p. 2371-2375.
Tripet, B., et al., Engineering a de novo designed coiled-coil heterodimerization domain for the rapid detection, purification and characterization of recombinantly expressed peptides and proteins. Protein Eng, 1996. 9(11): 1029-1042.
Truffer, F., et al., Compact portable biosensor for arsenic detection in aqueous samples with *Escherichia coli* bioreporter cells. Rev Sci Instrum, 2014. 85(1): p. 015120. 5 pages.
Utturkar, S.M., et al., Draft genome sequence for *Caulobacter* sp. strain OR37, a bacterium tolerant to heavy metals. Genome announcements, 2013.1(3): p. e00322-13.
VanEngelen, M.R., et al., UO(2) 2+ speciation determines uranium toxicity and bioaccumulation in an environmental *Pseudomonas* sp. isolate. Environ Toxicol Chem, 2010. 29(4): p. 763-9.
Von Canstein, H., et al., Secretion of flavins by *Shewanella* species and their role in extracellular electron transfer. Applied and environmental microbiology, 2008. 74(3): p. 615-623.
Wade, J.T., Where to begin? Mapping transcription start sites genome-wide in *Escherichia coli*. Journal of bacteriology, 2015. 197(1): p. 4-6.
Wang, B., et al., Engineering modular and orthogonal genetic logic gates for robust digital-like synthetic biology. Nature communications, 2011. 2: p. 508. 9 pages.
Wang, B., M. Barahona, and M. Buck, Engineering modular and tunable genetic amplifiers for scaling transcriptional signals in cascaded gene networks. Nucleic Acids Res, 2014. 42(14): p. 9484-92.
Weinberg, Z., et al., Comparative genomics reveals 104 candidate structured RNAs from bacteria, archaea, and their metagenomes. Genome Biol, 2010. 11(3): p. R31. 17 pages.
Wilkins, M., et al., The influence of microbial redox cycling on radionuclide mobility in the subsurface at a low-level radioactive waste storage site. Geobiology, 2007. 5(3): p. 293301.
Williams et al., "Bioremediation of uranium-contaminated groundwater: a systems approach to subsurface biogeochemistry". Current Opinion in biotechnology, 2013. 24(3): p. 489-497.
Williams, K.H., et al., Acetate availability and its influence on sustainable bioremediation of uranium-contaminated groundwater. Geomicrobiology Journal, 2011. 28(5-6): p. 519539.
Wogman, N.A., Prospects for the introduction of wide area monitoring using environmental sampling for proliferation detection. Journal of Radioanalytical and Nuclear Chemistry, 2013. 296(2): p. 1071-1077.
Written Opinion for International Application No. PCT/US2018/061667 filed on Nov. 16, 2018 on behalf of Lawrence Livermore National Security, LLC. dated Jun. 26, 2019. 7 pages.

(56) References Cited

OTHER PUBLICATIONS

Wu, Q., R.A. Sanford, and F.E. Loffler, Uranium (VI) reduction by Anaeromyxobacter dehalogenans strain 2CP-C. Applied and environmental microbiology, 2006. 72(5): p. 3608-3614.

Wu, W.-M., et al., In situ bioreduction of uranium (VI) to submicromolar levels and reoxidation by dissolved oxygen. Environmental Science & Technology, 2007. 41(16): p. 5716-5723.

Yagi, K., Applications of whole-cell bacterial sensors in biotechnology and environmental science. Appl Microbiol Biotechnol, 2007. 73(6): p. 1251-8.

Yung, M.C. and Y. Jiao, Biomineralization of uranium by PhoY phosphatase activity aids cell survival in Caulobacter crescentus. Applied and environmental microbiology, 2014. 80(16): p. 4795-4804.

Yung, M.C., et al., Shotgun proteomic analysis unveils survival and detoxification strategies by Caulobacter crescentus during exposure to uranium, chromium, and cadmium. J Proteome Res, 2014. 13(4): p. 1833-47.

Zhao, B., et al., An excited state underlies gene regulation of a transcriptional riboswitch. Nat Chem Biol, 2017. 13(9): p. 968-974.

Zheng, J., Spectroscopy-based quantitative fluorescence resonance energy transfer analysis. Ion channels: methods and protocols, 2006: p. 65-77.

Zhou, B., et al., The global regulatory architecture of transcription during the Caulobacter cell cycle. PLoS Genet, 2015. 11(1): p. e1004831. 17 pages.

Zhou, L., et al., A protein engineered to bind uranyl selectively and with femtomolar affinity. Nat Chem, 2014. 6(3): p. 236-41.

\* cited by examiner

A

P<sub>phyt</sub> sequence

CCCAAAGAGGGTGTGGCCCAAAGAGGGTGTGGATTTCTCTTCGCGC
tandem repeat (TR)
CACCCGTTTCGTCAGCCGGACGTCAGGTCCAGACGGCTAAGCTAGC
     DR1          DR2
TGCGA  Regulator Direct Repeat

B

P<sub>1361</sub> sequence

ATGTTCAGCGCCTGGTTACCGGCGATGGCGCGGTGTCAGCGTTCGG

GCGTTGCGATGCGTCAGGAGCGTGTCAGGATGCCTGTGGAATCCTA
     DR1          DR2
AGCGC  Regulator Direct Repeat

C

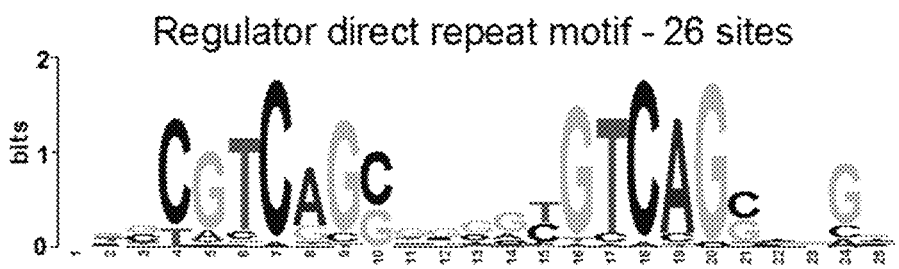

FIG. 7

A. P_phyt DNA sequence
CGGACGGTGACCGGCAAACCACCGCTGTCATGAATGCGTTTTGAAGCTTCGCCATAACGCGCCTTGGGTA
TCCGGTTCGGAACGCGGCGCTTTCGTTGACCTCTGGCCACGGAGAATTCTCCATCCCAAAGAGGGTGTGG
CCCAAAGAGGGTGTGGATTTCTCTTCGCGCCACCCGTTT*CGTCAGCCGGACGTCAGGT*CCAGACGGCTAA
GCTAGCTGCgaGAC*atg*AAAACGAG (SEQ ID NO:72)

B. P_phyt DR2 GTCA -> CAGT (mutation in bold)
CGGACGGTGACCGGCAAACCACCGCTGTCATGAATGCGTTTTGAAGCTTCGCCATAACGCGCCTTGGGTA
TCCGGTTCGGAACGCGGCGCTTTCGTTGACCTCTGGCCACGGAGAATTCTCCATCCCAAAGAGGGTGTGG
CCCAAAGAGGGTGTGGATTTCTCTTCGCGCCACCCGTTT*CGTCAGCCGGAC*CAGT*GGT*CCAGACGGCTAA
GCTAGCTGCgaGAC*atg*AAAACGAG (SEQ ID NO:73)

C. P_phyt DR1 GT -> CA (mutation in bold)
CGGACGGTGACCGGCAAACCACCGCTGTCATGAATGCGTTTTGAAGCTTCGCCATAACGCGCCTTGGGTA
TCCGGTTCGGAACGCGGCGCTTTCGTTGACCTCTGGCCACGGAGAATTCTCCATCCCAAAGAGGGTGTGG
CCCAAAGAGGGTGTGGATTTCTCTTCGCGCCACCCGTTT*CA**CAGCCGGACGTCAGGT*CCAGACGGCTAA
GCTAGCTGCgaGAC*atg*AAAACGAG (SEQ ID NO: 74)

D. P_phyt DR2 GT -> CA (mutation in bold)
CGGACGGTGACCGGCAAACCACCGCTGTCATGAATGCGTTTTGAAGCTTCGCCATAACGCGCCTTGGGTA
TCCGGTTCGGAACGCGGCGCTTTCGTTGACCTCTGGCCACGGAGAATTCTCCATCCCAAAGAGGGTGTGG
CCCAAAGAGGGTGTGGATTTCTCTTCGCGCCACCCGTTT*CGTCAGCCGGAC*CA**CAGGT*CCAGACGGCTAA
GCTAGCTGCgaGAC*atg*AAAACGAG (SEQ ID NO: 75)

E. P_phyt short
GGATTTCTCTTCGCGCCACCCGTTT*CGTCAGCCGGACGTCAGGT*CCAGACGGCTAAGCTAGCTGCgaGAC
*atg*AAAACGAG (SEQ ID NO:76)

FIG. 8

F.   P₁₃₆₁ DNA sequence
GAACGATAGCGCCGCCTGCGAGCGCGACCTCAGGCCTCGGACGAAGCGCGTCCGGGGCCTTTTCTTGTCG
ATGTTCAGCGCCTGGTTACCGGCGATGGCGCGGTGTCAGCGTTCGGGCGTTGCGATG*CGTCAGGAGCGTG*
*TCAGGA*TGCCTGTGGAATCCTAAGCG<u>c</u>C*at g*ACCCAGTCCCGATCTTTCC (SEQ ID NO:77)

G.   P₁₃₆₁ DR2 GTCA -> CAGT (mutation in bold)
GAACGATAGCGCCGCCTGCGAGCGCGACCTCAGGCCTCGGACGAAGCGCGTCCGGGGCCTTTTCTTGTCG
ATGTTCAGCGCCTGGTTACCGGCGATGGCGCGGTGTCAGCGTTCGGGCGTTGCGATG*CGTCAGGAGCGT***C
AGT**GGATGCCTGTGGAATCCTAAGCG<u>c</u>C*at g*ACCCAGTCCCGATCTTTCC (SEQ ID NO:78)

H.   P₁₃₆₁ DR2 GT -> CA (mutation in bold)
GAACGATAGCGCCGCCTGCGAGCGCGACCTCAGGCCTCGGACGAAGCGCGTCCGGGGCCTTTTCTTGTCG
ATGTTCAGCGCCTGGTTACCGGCGATGGCGCGGTGTCAGCGTTCGGGCGTTGCGATG*CGTCAGGAGCGT***C
ACAGG**ATGCCTGTGGAATCCTAAGCG<u>c</u>C*at g*ACCCAGTCCCGATCTTTCC (SEQ ID NO: 79)

I.   P₁₃₆₁ short
GCGTTGCGATG*CGTCAGGAGCGTGTCAGGA*TGCCTGTGGAATCCTAAGCG<u>c</u>C*at g*ACCCAGTCCCGATCT
TTCC (SEQ ID NO: 80)

FIG. 8 (cont.)

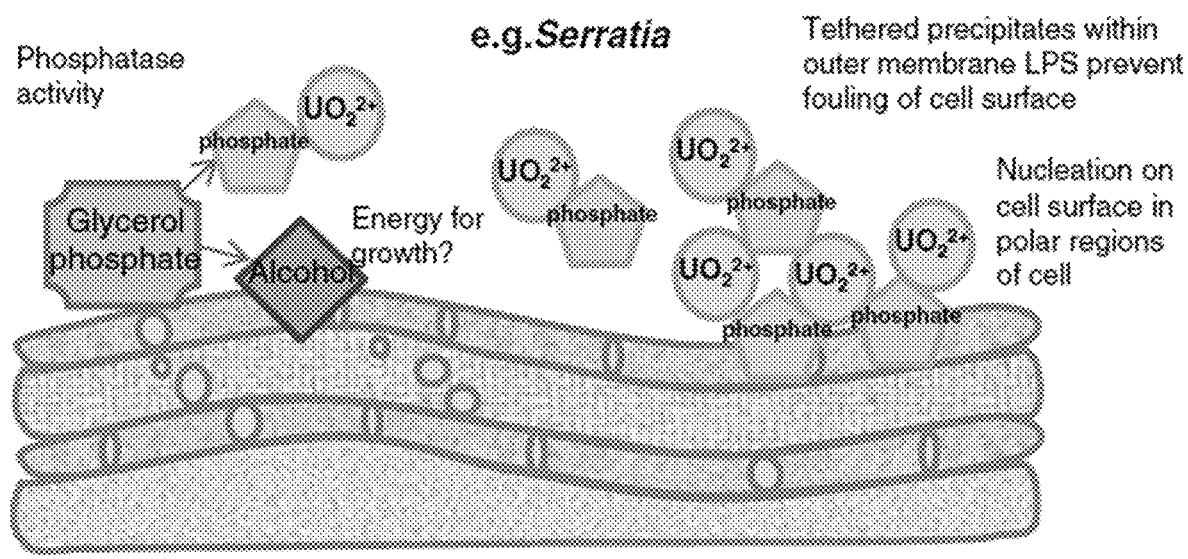
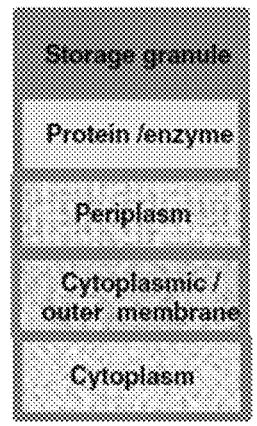
FIG. 16B

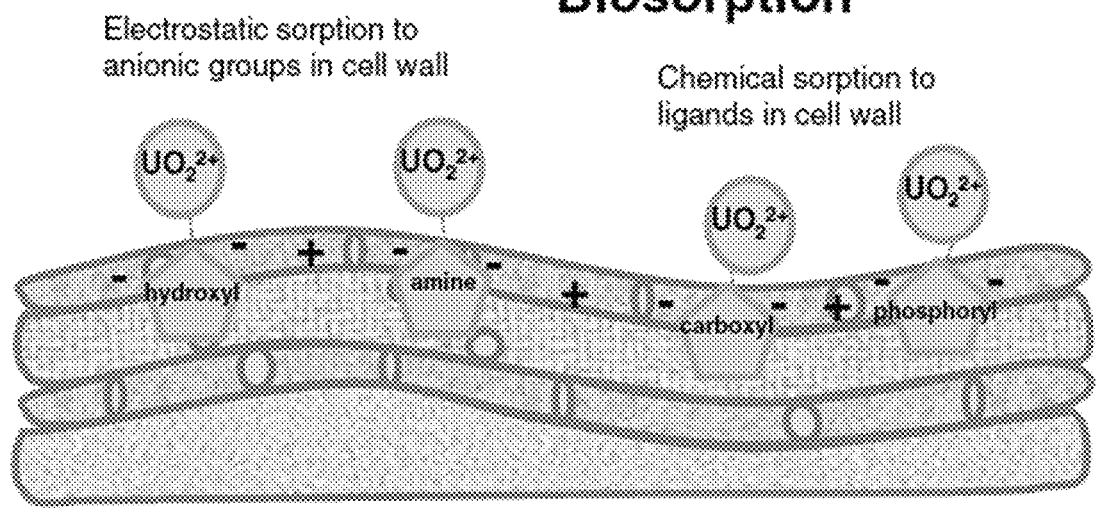
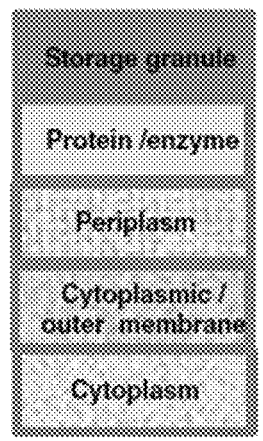
FIG. 16C

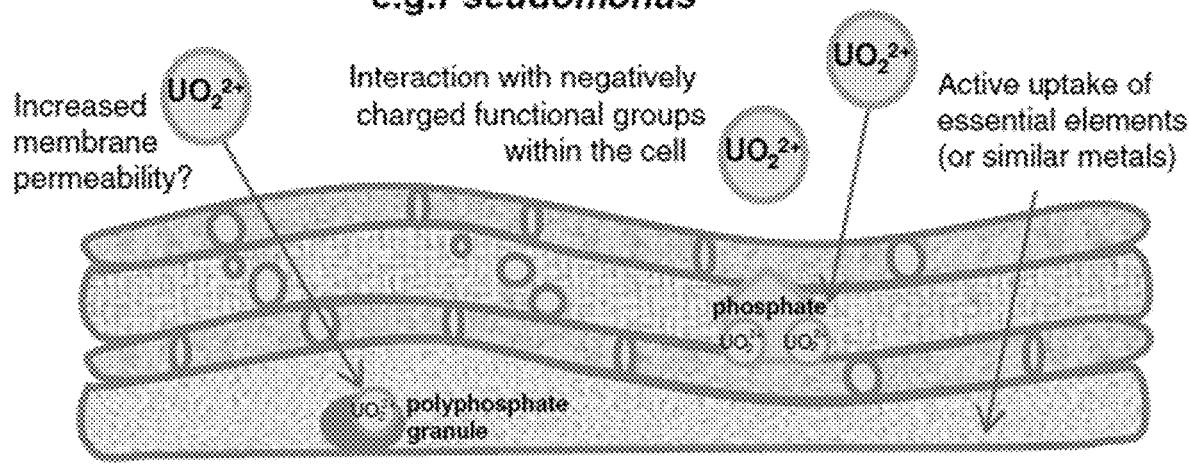
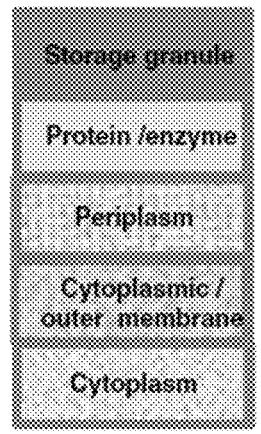
FIG. 16D

Single Output UO$_2$F$_2$ Sensor Configurations
In-Series UO$_2$F$_2$ sensor
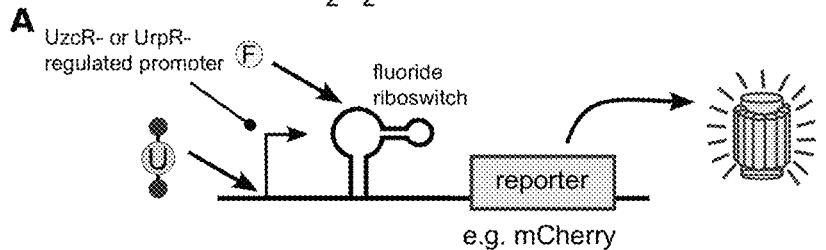
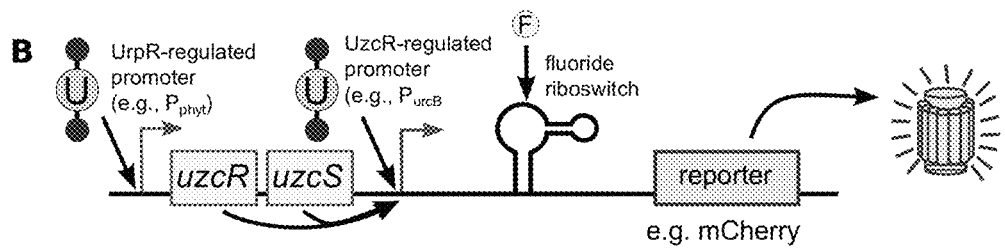
In-Parallel UO$_2$F$_2$ sensor
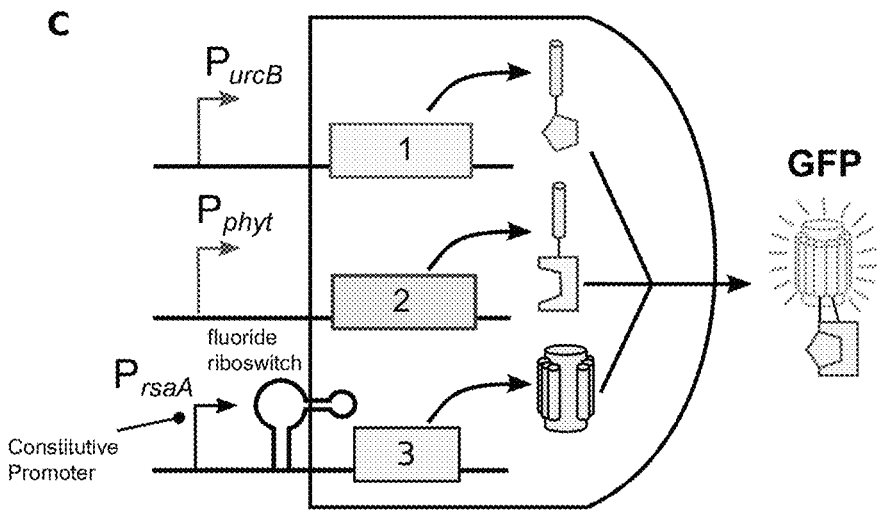
FIG. 46

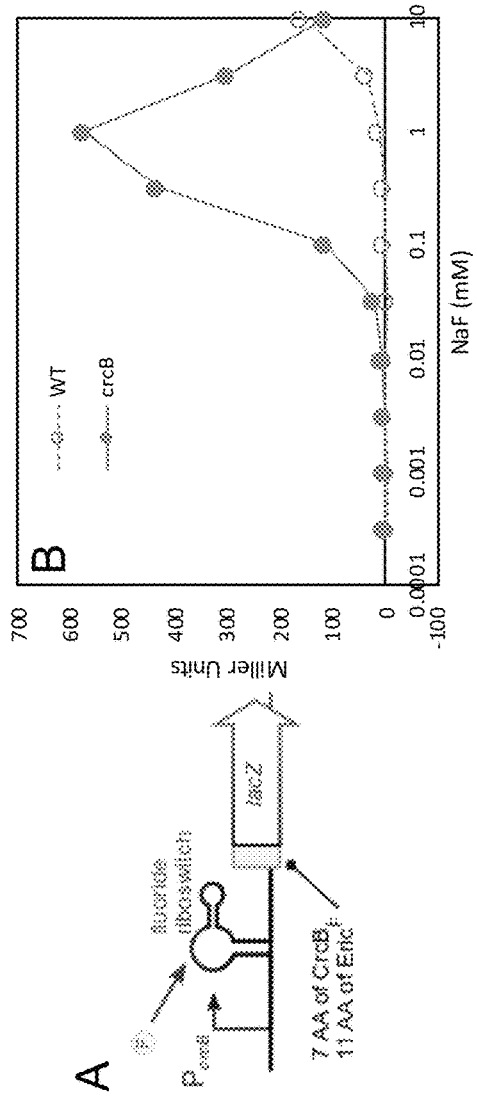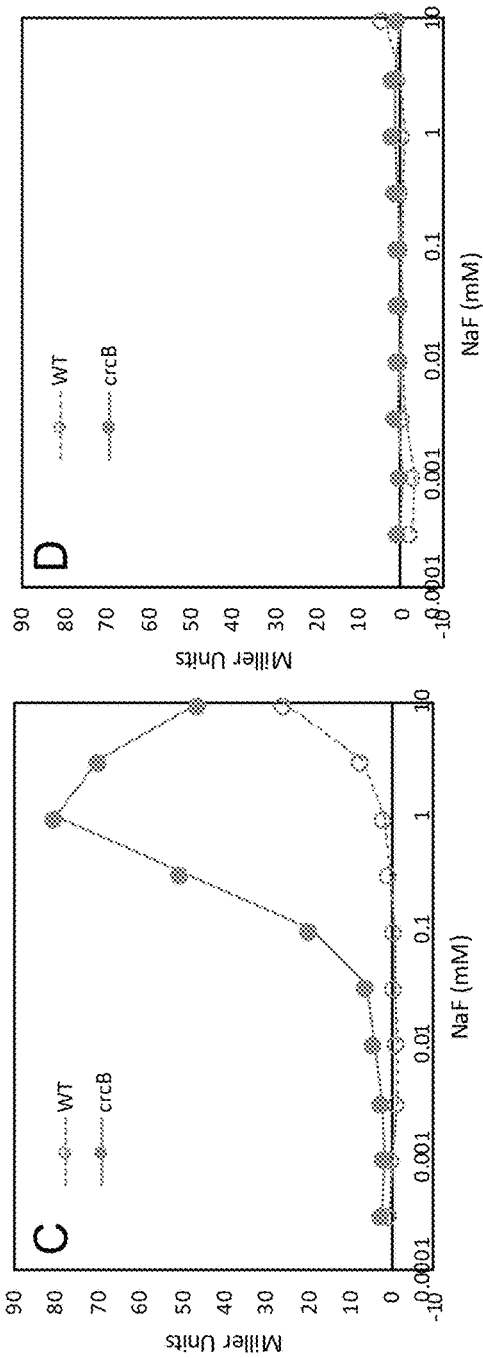
FIG. 50

```
>AAFX01041918.1/5809-577
AAGUCCGAACCGCUGGA-GUC-CGCCA------------------------------------CGUGGCCAAUGACUCCUGCGGGUU----CAA-CCGUCAUG--------
----CGCCUGC
>AE006641.1/885812-885739
AAUGAAGUAGUGGGGAUGGC-GUC-CCGCU---------------------------------------AUAA----------------------GGG----AUA-----
----UUGAUUAAUGAUA--------------------------GGGCCUGAUGACGCCUACUUCACC----CCCCGAA-CCGCCUC-------
>ABCB01000002.1/2875-2959
UGCAACCAAGUGGAUGGG-GUU-CACCCU---------------------------------------UGCU-------------------------------------
-----AAAUC------------------GGCUGAUGACUCCUACAGUUC----UAA-CCGCC--------
>CP000869.1/4793369-4793299
UAUCCUAUAGGUGAUGAA-GUC-CGCCA-----------------------------------------AGAU--------UUACA-----------------------
-----UUAU------------GCUGAUGACUCUACAUUAAU----GUCUAAA-CCGC---------
>CP01364.1/429603-429664
AAUCGAUUGGGUGAUGAG-GCU-CACCCU---------------------------------------------------------------------------------
----AUUAC---------------------GGCUGAUAGCCUCUACAGUGAA----CAA-CUGCC--------
>ABCR01000008.1/195508-93493
AUUGGGUGAUGGGUGAUGGG-GUGCCACCG---------------------------------------GAAUC---------------------------------
----UGUAU------------AGCUGAUGACUCUACAGAAAC----GAUUCAAA-CCGCU--------
>AE017333.1/4836662-4836721
AUAAUCAUACGGCGAUGGA-GUU-CGCCA----------------------------------AGUAAUGACUCCUACCAGUAU---------------------UAA-ACGCU--------
----GCUU
>CP000668.1/3010272-3010325
UCAAGAUCUCGAGAUGAC-ACCGCCUCCA-----------------------------GGCUAAUGAUGUCUAGCUGAC-----------------------UAA-CCGCC--------
----CUAACAA
>AAWP01000027.1/44793-44888
AAUCACACAGGGGGAUGGG-GUGCCACCA---------------------------------------GAAA-------------------------------------
----UUAC---------------------AGCUGAUGACUCCUACAGAAAC----GAUUCAAA-CCGCU--------
>AE008923.1/2252963-2253030
GGCCGCACAGGAGAUGGC-AUUCUCCCUC---------------------------------------------------------------------------------
----ACCC---------------------GCGGCUGAUGAUGCCUGCCACCC----GAA-CCCCACGC--------
>AACY020246117.1/2623-2561
UUGCCCGCUGGAGAUGGC-AUU-CUCCAU----------------------------------------------------------------------------------
----CUGAU----------------GGCUGAUGAUGCCUGCCUUCGCC----UAA-CCGCC--------
>ABCM01000023.1/34798-34866
```

BIOSENSORS FOR DETECTING AND/OR NEUTRALIZING BIOAVAILABLE URANIUM AND RELATED U-SENSITIVE GENETIC MOLECULAR COMPONENTS, GENE CASSETTES, VECTORS, GENETIC CIRCUITS, COMPOSITIONS, METHODS AND SYSTEMS

CROSS REFERENCE TO RELATED APPLICATIONS

The present application claims priority to U.S. provisional application No. 62/801,077 entitled "Biosensors for detecting and/or Neutralizing Bioavailable Uranium and Related U-sensitive Genetic Molecular components, Gene Cassettes, Vectors, Genetic Circuits, Compositions, Methods and Systems' filed on Feb. 4, 2019, which is incorporated by reference in its entirety. The present application is further related to International Application Number PCT/US2020/016654 entitled "Biosensors for detecting and/or Neutralizing Bioavailable Uranium and Related U-sensitive Genetic Molecular components, Gene Cassettes, Vectors, Genetic Circuits, Compositions, Methods and Systems" filed on Feb. 4, 2020 herein incorporated by reference in its entirety. The present application is also related to International patent application PCT/US2018/061667, entitled "Biosensors for Detecting and/or Neutralizing Bioavailable Uranium And Related U-Sensitive Genetic Molecular Components, Gene Cassettes, Vectors, Genetic Circuits, Compositions, Methods And Systems" filed on Nov. 16, 2018 which claims priority to U.S. provisional application No. 62/587,753, entitled "Biosensors for Detecting and/or Neutralizing Bioavailable Uranium And Related U-Sensitive Genetic Molecular Components, Gene Cassettes, Vectors, Genetic Circuits, Compositions, Methods And Systems" filed on Nov. 17, 2017, the disclosure of each of which is incorporated by reference in its entirety.

STATEMENT OF GOVERNMENT GRANT

This United States Government has rights in this invention pursuant to Contract No. LDRD #16-LW-055 between the United States Department of Energy and Lawrence Livermore National Security, LLC, for the operation of Lawrence Livermore National Laboratory.

FIELD

The present disclosure relates to uranium (U) biosensors and related U-sensitive genetic molecular components, gene cassettes, vectors, genetic circuits, compositions, methods and systems. In particular, the present disclosure relates to U biosensors and related methods and systems to detect and/or neutralize bioavailable uranium and more particularly bioavailable uranyl oxycation.

BACKGROUND

Various methods and systems such as spectroscopy as well as antibodies and DNA enzymes are available to monitor environmental U concentrations which is important to minimize human exposure and inform remediation strategies.

In particular, detection of U in an environment in situ and more particularly detection of bioavailable U that can transverse the cell membrane and exert toxicity, is an important part of an evaluation of the potential risk of environmental U exposure.

However, despite availability of various approaches, development of sensing technologies that provide sensitive, selective and/or cost-effective detection of bioavailable U is still challenging.

SUMMARY

Provided herein are U biosensors, and related U-sensing genetic molecular components, gene cassettes, genetic circuits, compositions, methods and systems which in several embodiments can be used to detect and/or neutralize uranium and in particular bioavailable $UF_6$, or its stable hydrolysis product $UO_2F_2$, which is typically produced in U enrichment operations.

According to a first aspect, a $UO_2F_2$-biosensor is described comprising a U-sensing genetic molecular component and an F-sensing riboswitch configured to report and/or neutralize uranium in presence of bioavailable Uranium and Fluoride, in a single output or dual output configuration. The $UO_2F_2$-biosensor comprises a genetically modified bacterial cell capable of natively and/or heterologously expressing histidine kinase 1363 herein also UrpS, and U sensitive transcriptional regulator 1362 herein also UrpR.

In the $UO_2F_2$-biosensor, the genetically modified bacterial cell is an engineered bacterial cell comprising a 1362 U-sensing reportable genetic molecular component and/or a 1362 U-sensing/U-neutralizing genetic molecular component, each comprising a U-sensitive promoter in a configuration wherein the U-sensitive promoter directly initiates expression of the 1362 U-sensing reportable molecular component and/or of the 1362U-neutralizing molecular component in presence of bioavailable U.

In the U-biosensor, the 1362 U-sensitive promoter comprises a 1362 (UrpR) binding site having a DNA sequence (SEQ ID NO: 1)
$N_1N_2N_3N_4N_5N_6N_7N_8N_9N_{10}N_{11}N_{12}N_{13}N_{14}N_{15}N_{16}N_{17}N_{18}$, wherein
$N_1$ is C or T, preferably C;
$N_2$ is G or A, preferably G;
$N_3$ is T or C, preferably T;
$N_4$ is C;
$N_5$ is A or G, preferably A;
$N_6$ is G or C, preferably G;
$N_7$ C or G;
$N_8$ is any nucleotide;
$N_9$ is any nucleotide;
$N_{10}$ is any nucleotide;
$N_{11}$ is any nucleotide;
$N_{12}$ is T or C;
$N_{13}$ is G;
$N_{14}$ is T or C, preferably T;
$N_{15}$ is C;
$N_{16}$ is A or C, preferably A;
$N_{17}$ is G; and
$N_{18}$ is C or G,
and wherein $N_1$ to $N_{17}$ are selected independently.
In the $UO_2F_2$-biosensor, the genetically modified bacterial cell is an engineered bacterial cell further comprising an F-sensing riboswitch within at least one of the 1362 U-sensing reportable genetic molecular component wherein the 1362 U-sensing reportable genetic molecular component, is transcribed in presence of an effective amount of bioavailable fluoride, an F-sensing reportable genetic molecular component in a configuration wherein the F-sensing reportable genetic molecular component is transcribed in presence of an effective amount of bioavailable fluoride, and an F sensitive genetic circuit in which at least one molecular component is a reportable molecular component (and in particular one or more reportable genetic molecular component and/or one or more reportable cellular molecular component), the reportable molecular component expressed when the genetic circuit operates according to the circuit design in presence of bioavailable F.

In the $UO_2F_2$-biosensor comprising the F-sensing riboswitch within the 1362 U-sensing reportable genetic molecular component, the F-sensing riboswitch and the 1362 U-sensing reportable genetic molecular component are in a single output configuration.

In the $UO_2F_2$-biosensor comprising the F-sensing reportable genetic molecular component and/or the F-sensing genetic circuit, the F-sensing riboswitch and the 1362 U-sensing reportable genetic molecular component are in a dual output configuration.

In some embodiments, the genetically modified bacteria are bacteria incapable of natively expressing the histidine kinase 1363 (UrpS) and the U-sensitive transcriptional regulator 1362 (UrpR) (e.g. *E. coli* bacteria). In those embodiments the bacterial cell is further engineered to include a 1362 U-sensing regulator genetic molecular component comprising an endogenous or exogenous gene encoding histidine kinase 1363 (UrpS), and an endogenous or exogenous gene encoding U-sensitive transcriptional regulator 1362 (UrpR) in a configuration wherein the a gene encoding histidine kinase 1363(UrpS), and a gene encoding response regulator 1362 are expressed upon activation of a controllable promoter.

In some embodiments, the genetically modified bacteria are bacteria capable of natively expressing histidine kinase 1363 (UrpS), and U-sensitive transcriptional regulator 1362 (UrpR) (e.g. proteobacteria such as certain alpha proteobacteria, beta proteobacteria and/or gamma proteobacteria identifiable by a skilled person upon reading of the present disclosure). In some of those embodiments, the endogenous genes encoding the histidine kinase 1363, and the U-sensitive transcriptional regulator 1362 (UrpR), are knocked out and the genetically engineered bacterial cell is further engineered to include a 1362 U-sensing regulator genetic molecular component comprising an endogenous or exogenous gene encoding histidine kinase 1363(UrpS), and an endogenous or exogenous gene encoding U-sensitive transcriptional regulator 1362 (UrpR) in a configuration wherein the a gene encoding histidine kinase 1363 (UrpS), and a gene encoding response regulator 1362 (UrpR) are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding the F-sensing riboswitch, are preferably knocked out.

According to a second aspect, a $UO_2F_2$-biosensor is described, comprising a U-sensitive F-sensitive genetic circuit wherein a U-sensing genetic molecular component and an F-sensing riboswitch are configured to report and/or neutralize uranium in presence of bioavailable Uranium and Fluoride, in a single output or dual output configurations. The $UO_2F_2$ biosensor according to the second aspect comprises a genetically modified bacterial cell capable of natively and/or heterologously expressing histidine kinase 1363 (UrpS) and response regulator 1362 (UrpR). In the $UO_2F_2$-biosensor, the genetically modified bacterial cell is an engineered bacterial cell comprising a U-sensitive F-sensitive genetic circuit in which molecular components are connected one to another in accordance to a circuit design by activating, inhibiting, binding or converting reactions to form a fully connected network of interacting components. In the 1362 U-sensitive F-sensitive genetic circuit at least one molecular component is a 1362 U-sensing genetic molecular component in which a U-sensitive promoter is activated or repressed in presence of bioavailable U, the U sensitive promoter comprising a U-sensitive 1362 (UrpR) binding site having a DNA sequence (SEQ ID NO: 1)
$N_1N_2N_3N_4N_5N_6N_7N_8N_9N_{10}N_{11}N_{12}N_{13}N_{14}N_{15}N_{16}N_{17}N_{18}$, wherein
$N_1$ is C or T, preferably C;
$N_2$ is G or A, preferably G;
$N_3$ is T or C, preferably T;
$N_4$ is C;
$N_5$ is A or G, preferably A;
$N_6$ is G or C, preferably G; $N_7$ C or G;
$N_8$ is any nucleotide;
$N_9$ is any nucleotide;
$N_{10}$ is any nucleotide;
$N_{11}$ is any nucleotide;
$N_{12}$ is T or C;
$N_{13}$ is G;
$N_{14}$ is T or C, preferably T;
$N_{15}$ is C;
$N_{16}$ is A or C, preferably A;
$N_{17}$ is G; and
$N_{18}$ is C or G,
and wherein $N_1$ to $N_{17}$ are selected independently.

In the U-sensitive F-sensitive genetic circuit, at least one molecular component is a reportable molecular component (and in particular one or more reportable genetic molecular component and/or one or more reportable cellular molecular component), and/or a U-neutralizing molecular component, (in particular one or more U-neutralizing genetic molecular component and/or one or more U-neutralizing cellular molecular component).

In the $UO_2F_2$-biosensor, the 1362 U-sensing F-sensing genetic circuit further comprises an F sensing riboswitch within at least one genetic molecular component of the molecular components of the U-sensitive F-sensitive genetic circuit, in a configuration wherein the at least one genetic molecular component is transcribed in presence of an effective amount of bioavailable fluoride.

In the $UO_2F_2$-biosensor, the at least one reportable molecular component and/or the U-neutralizing molecular component are expressed when the genetic circuit operates according to the circuit design in presence of an effective amount of bioavailable U and an effective amount of bioavailable F in a single output or dual output configurations.

In some embodiments, the genetically modified bacteria are bacteria not capable of natively expressing the histidine kinase 1363 (UrpS) and the U-sensitive transcriptional regulator 1362 (UrpR) (e.g. *E. coli* bacteria). In those embodiments, the bacterial cell is further engineered to include a 1362 U-sensing regulator genetic molecular component comprising an endogenous or exogenous gene encoding histidine kinase 1363(UrpS), and an endogenous or exogenous gene encoding U-sensitive transcriptional regulator 1362 (UrpR) in a configuration wherein the a gene encoding histidine kinase 1363 (UrpR), and a gene encoding response regulator 1362(UrpR) are expressed upon activation of a controllable promoter.

In some embodiments, the genetically modified bacteria are bacteria capable of natively expressing histidine kinase 1363(UrpS), and U-sensitive transcriptional regulator 1362 (UrpR) (e.g. proteobacteria, such as certain alpha proteobacteria, beta proteobacteria and/or gamma proteobacteria identifiable by a skilled person upon reading of the present disclosure). In some of those embodiments, the endogenous genes encoding the histidine kinase 1363(UrpS), and the U-sensitive transcriptional regulator 1362(UrpR), can be preferably knocked out and the genetically engineered bacterial cell is further engineered to include a 1362 U-sensing regulator genetic molecular component comprising an endogenous or exogenous gene encoding histidine kinase 1363 (UrpS), and an endogenous or exogenous gene encoding U-sensitive transcriptional regulator 1362 in a configuration wherein the a gene encoding histidine kinase 1363 (UrpS), and a gene encoding response regulator 1362 (UrpR) are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding the F-sensing riboswitch, are preferably knocked out.

According to a third aspect, a $UO_2F_2$-biosensor is described, comprising a U-sensing genetic molecular component and an F-sensing riboswitch configured to report and/or neutralize uranium in presence of bioavailable Fluoride, in a single output or double output configuration.

The $UO_2F_2$ biosensor comprises a genetically modified bacterial cell capable of natively and/or heterologously expressing histidine kinase UzcS and U-sensitive transcriptional response regulator UzcR.

In the U-biosensors, the genetically modified bacterial cell is an engineered bacterial cell comprising a UzcR U-sensing reportable genetic molecular component and/or a UzcR U-sensing U-neutralizing genetic molecular component, each comprising a U-sensitive promoter in a configuration wherein the U-sensitive promoter directly initiates expression of the UzcR U-sensing reportable molecular component and/or of the UzcR U-sensing U-neutralizing molecular component in presence of bioavailable U.

In the U-biosensor, the U-sensitive promoter comprises an UzcR binding site having a DNA sequence:

$$\text{CATTACN}_7\text{N}_8\text{N}_9\text{N}_{10}\text{N}_{11}\text{N}_{12}\text{TTAA} \quad \text{(SEQ ID NO: 2)}$$

wherein $N_7$-$N_{12}$ is independently any nucleotide, and in some embodiments any one of $N_7$-$N_{11}$ can independently be A.

In the $UO_2F_2$-biosensor, the genetically modified bacterial cell is an engineered bacterial cell further comprising an F-sensing riboswitch within at least one of the UzcR U-sensing reportable genetic molecular component wherein the UzcR U-sensing reportable genetic molecular component, is transcribed in presence of an effective amount of bioavailable fluoride, an F-sensing reportable genetic molecular component in a configuration wherein the F-sensing reportable genetic molecular component is transcribed in presence of an effective amount of bioavailable fluoride, and an F sensitive genetic circuit in which at least one molecular component is a reportable molecular component (and in particular one or more reportable genetic molecular component and/or one or more reportable cellular molecular component), the reportable molecular component expressed when the genetic circuit operates according to the circuit design in presence of bioavailable F.

In the $UO_2F_2$-biosensor comprising the F-sensing riboswitch within the UzcR U-sensing reportable genetic molecular component, the F-sensing riboswitch and the UzcR U-sensing reportable genetic molecular component are in a single output configuration.

In the $UO_2F_2$-biosensor comprising the F-sensing reportable genetic molecular component and/or the F-sensing genetic circuit, the F-sensing riboswitch and the UzcR U-sensing reportable genetic molecular component are in a dual output configuration.

In some embodiments, the genetically modified bacteria are bacteria not capable of natively expressing the histidine kinase UzcS, and the U-sensitive transcriptional response regulator UzcR (e.g. *E. coli* bacteria), and the bacterial cell is further engineered to include a UzcR U-sensing regulator genetic molecular component comprising an endogenous or exogenous gene encoding the histidine kinase UzcS, and an endogenous or exogenous gene encoding the U-sensitive transcriptional response regulator UzcR, in a configuration wherein the gene encoding the histidine kinase UzcS, and the gene encoding the U-sensitive transcriptional response regulator UzcR, are expressed upon activation of a controllable promoter.

In some embodiments, the genetically modified bacteria are bacteria capable of natively expressing the histidine kinase UzcS, and the U-sensitive transcriptional response regulator UzcR (e.g. proteobacteria, such as certain alpha proteobacteria, beta proteobacteria and/or gamma proteobacteria identifiable by a skilled person upon reading of the present disclosure). In some of those embodiments, in the bacterial cell, the endogenous genes encoding the histidine kinase UzcS, and the U-sensitive transcriptional response regulator UzcR, can be preferably knocked out and the genetically engineered bacterial cell can be further engineered to include a UzcR U-sensing regulator genetic molecular component comprising an endogenous or exogenous gene encoding histidine kinase UzcS, and an endogenous or exogenous gene encoding U-sensitive transcriptional response regulator UzcR in a configuration wherein the a gene encoding histidine kinase UzcS, and a gene encoding response regulator UzcR are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding the F-sensing riboswitch, are preferably knocked out.

According to a fourth aspect, a $UO_2F_2$-biosensor is described, comprising a U-sensitive F-sensitive genetic circuit wherein a UzcR U-sensing genetic molecular component and an F-sensing riboswitch are configured to report and/or neutralize uranium in presence of bioavailable Uranium and Fluoride, in a single output or dual output configurations.

The U biosensor comprises a genetically modified bacterial cell natively and/or heterologously expressing histidine kinase UzcS, and response regulator UzcR.

In the $UO_2F_2$-biosensor, the genetically modified bacterial cell is an engineered bacterial cell comprising a U-sensitive F-sensitive genetic circuit in which molecular components are connected one to another in accordance to a circuit design by activating, inhibiting, binding or converting reactions to form a fully connected network of interacting components. In the UzcR U-sensitive F-sensitive genetic circuit at least one molecular component is a UzcR U-sensing genetic molecular component in which a U-sensitive promoter is activated or repressed in presence of bioavailable U, the U sensitive promoter comprising a UzcR binding site having DNA sequence:

$$CATTACN_7N_8N_9N_{10}N_{11}N_{12}TTAA \quad \text{(SEQ ID NO: 2)}$$

wherein $N_7$-$N_{12}$ is independently any nucleotide, and in some embodiments any one of $N_7$-$N_{11}$ can independently be A.

In the UzcR U-sensitive F-sensitive genetic circuit at least one molecular component is a reportable molecular component (and in particular one or more reportable genetic molecular component and/or one or more reportable cellular molecular component), and/or a U-neutralizing molecular component, (in particular one or more U-neutralizing genetic molecular component and/or one or more U-neutralizing cellular molecular component), In the $UO_2F_2$-biosensor the genetically modified bacterial cell further comprises an F-sensing riboswitch within at least one genetic molecular component of the molecular components of the U-sensitive F-sensitive genetic circuit in a configuration wherein the at least one genetic molecular component is transcribed in presence of an effective amount of bioavailable fluoride.

In the $UO_2F_2$-biosensor, the at least one reportable molecular component and/or the a U-neutralizing molecular component are expressed when the genetic circuit operates according to the circuit design in presence of an effective amount of bioavailable U and an effective amount of bioavailable F in a single output or dual output configurations. In some embodiments, the genetically modified bacteria are bacteria not capable of natively expressing the histidine kinase UzcS, and the U-sensitive transcriptional response regulator UzcR (e.g. *E. coli* bacteria). In those embodiments, the bacterial cell is further engineered to include a UzcR U-sensing regulator genetic molecular component comprising an endogenous or exogenous gene encoding the histidine kinase UzcS, and an endogenous or exogenous gene encoding the U-sensitive transcriptional response regulator UzcR, in a configuration wherein the gene encoding the histidine kinase UzcS, and the gene encoding the U-sensitive transcriptional response regulator UzcR, are expressed upon activation of a controllable promoter.

In some embodiments, the genetically modified bacteria are capable of natively expressing the histidine kinase UzcS, and the U-sensitive transcriptional response regulator UzcR (e.g. proteobacteria, such as certain alpha proteobacteria, beta proteobacteria and/or gamma proteobacteria identifiable by a skilled person upon reading of the present disclosure). In some of those embodiments, in the bacterial cell, the endogenous genes encoding the histidine kinase UzcS, and the U-sensitive transcriptional response regulator UzcR, are knocked out. and the genetically engineered bacterial cell is further engineered to include a UzcR U-sensing regulator genetic molecular component comprising an endogenous or exogenous gene encoding histidine kinase UzcS, and an endogenous or exogenous gene encoding U-sensitive transcriptional response regulator UzcR in a configuration wherein the gene encoding histidine kinase UzcS, and a gene encoding response regulator UzcR are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding the F-sensing riboswitch, are preferably knocked out.

According to a fifth aspect, a $UO_2F_2$-biosensor is described comprising a U-sensing genetic circuit and an F-sensing riboswitch configured to report and/or neutralize uranium in presence of bioavailable Uranium and Fluoride in a dual output configuration. The $UO_2F_2$-biosensor comprises a genetically modified bacterial cell capable of natively and/or heterologously expressing histidine kinase 1363 herein also UrpS, and U sensitive transcriptional regulator 1362 herein also UrpR and/or natively and/or heterologously expressing histidine kinase UzcS, and response regulator UzcS.

In the $UO_2F_2$-biosensor, the genetically modified bacterial cell is an engineered bacterial cell comprising a U-sensitive genetic circuit in which molecular components are connected one to another in accordance to a circuit design by activating, inhibiting, binding or converting reactions to form a fully connected network of interacting components. In the U-sensitive genetic circuit at least one molecular component is a U-sensing genetic molecular component in which a U-sensitive promoter is activated or repressed in presence of bioavailable U.

In the U-sensitive genetic circuit, when the cell is capable of natively and/or heterologously expressing histidine kinase 1363 herein also UrpS, and U sensitive transcriptional regulator 1362 herein also UrpR, at least one molecular component is a 1362 U-sensing genetic molecular component in which the U sensitive promoter comprises a U-sensitive 1362 (UrpR) binding site having a DNA sequence $$N_1N_2N_3N_4N_5N_6N_7N_8N_9N_{10}N_{11}N_{12}N_{13}N_{14}N_{15}N_{16}N_{17}N_{18},$$
(SEQ ID NO: 1)

wherein
$N_1$ is C or T, preferably C;
$N_2$ is G or A, preferably G;
$N_3$ is T or C, preferably T;
$N_4$ is C;
$N_5$ is A or G, preferably A;
$N_6$ is G or C, preferably G; $N_7$ C or G;
$N_8$ is any nucleotide;
$N_9$ is any nucleotide;
$N_{10}$ is any nucleotide;
$N_{11}$ is any nucleotide;
$N_{12}$ is T or C;
$N_{13}$ is G;
$N_{14}$ is T or C, preferably T;
$N_{15}$ is C;
$N_{16}$ is A or C, preferably A;
$N_{17}$ is G; and
$N_{18}$ is C or G,
and wherein $N_1$ to $N_{17}$ are selected independently.

In addition or in the alternative, when the cell is natively and/or heterologously expressing histidine kinase UzcS, and response regulator UzcS, in the U-sensitive genetic circuit at least one molecular component is a UzcR U-sensing genetic molecular component in which a U-sensitive promoter is activated or repressed in presence of bioavailable U, the U sensitive promoter comprising a UzcR binding site having DNA sequence:

$$CATTACN_7N_8N_9N_{10}N_{11}N_{12}TTAA$$
(SEQ ID NO: 2)

wherein $N_7$-$N_{12}$ is independently any nucleotide, and in some embodiments any one of $N_7$-$N_{11}$ can independently be A.

In the U-sensitive genetic circuit, at least one molecular component is a reportable molecular component (and in particular one or more reportable genetic molecular component and/or one or more reportable cellular molecular component), and/or a U-neutralizing molecular component, (in particular one or more U-neutralizing genetic molecular component and/or one or more U-neutralizing cellular molecular component), the reportable molecular component and/or the a U-neutralizing molecular component expressed when the genetic circuit operates according to the circuit design in presence of bioavailable U.

In the $UO_2F_2$-biosensor the genetically modified bacterial cell is an engineered bacterial cell further comprising an F-sensing riboswitch within at least one of
a genetic molecular component of an F sensitive genetic circuit in which at least one molecular component is a reportable molecular component (and in particular one or more reportable genetic molecular component and/or one or more reportable cellular molecular component), the reportable molecular component expressed when the genetic circuit operates according to the circuit design in presence of bioavailable F; and
an F-sensing reportable genetic molecular component in a configuration wherein the F-sensing reportable genetic molecular component is transcribed in presence of an effective amount of bioavailable fluoride.

In the $UO_2F_2$-biosensor, the F-sensing reportable genetic molecular component and the F-sensing genetic circuit are in a dual output configuration with the U-sensing genetic circuit.

In some embodiments, the genetically modified bacteria are bacteria incapable of natively expressing the histidine kinase 1363 (UrpS) and the U-sensitive transcriptional regulator 1362 (UrpR) (e.g. E. coli bacteria). In those embodiments the bacterial cell is further engineered to include a U-sensing regulator genetic molecular component comprising an endogenous or exogenous gene encoding histidine kinase 1363 (UrpS), and an endogenous or exogenous gene encoding U-sensitive transcriptional regulator 1362 (UrpR) in a configuration wherein the a gene encoding histidine kinase 1363(UrpS), and a gene encoding response regulator 1362 are expressed upon activation of a controllable promoter.

In some embodiments, the genetically modified bacteria are bacteria capable of natively expressing histidine kinase 1363 (UrpS), and U-sensitive transcriptional regulator 1362 (UrpR) (e.g. proteobacteria such as certain alpha proteobacteria, beta proteobacteria and/or gamma proteobacteria identifiable by a skilled person upon reading of the present disclosure). In some of those embodiments, the endogenous genes encoding the histidine kinase 1363, and the U-sensitive transcriptional regulator 1362 (UrpR), are knocked out and the genetically engineered bacterial cell is further engineered to include a U-sensing regulator genetic molecular component comprising an endogenous or exogenous gene encoding histidine kinase 1363(UrpS), and an endogenous or exogenous gene encoding U-sensitive transcriptional regulator 1362 (UrpR) in a configuration wherein the a gene encoding histidine kinase 1363 (UrpS), and a gene encoding response regulator 1362 (UrpR) are expressed upon activation of a controllable promoter.

In some embodiments, the genetically modified bacteria are bacteria not capable of natively expressing the histidine kinase UzcS, and the U-sensitive transcriptional response regulator UzcR (e.g. E. coli bacteria), and the bacterial cell is further engineered to include a U-sensing regulator genetic molecular component comprising an endogenous or exogenous gene encoding the histidine kinase UzcS, and an endogenous or exogenous gene encoding the U-sensitive transcriptional response regulator UzcR, in a configuration wherein the gene encoding the histidine kinase UzcS, and the gene encoding the U-sensitive transcriptional response regulator UzcR, are expressed upon activation of a controllable promoter.

In some embodiments, the genetically modified bacteria are bacteria capable of natively expressing the histidine kinase UzcS, and the U-sensitive transcriptional response regulator UzcR (e.g. proteobacteria, such as certain alpha proteobacteria, beta proteobacteria and/or gamma proteobacteria identifiable by a skilled person upon reading of the present disclosure). In some of those embodiments, in the bacterial cell, the endogenous genes encoding the histidine kinase UzcS, and the U-sensitive transcriptional response regulator UzcR, can be preferably knocked out and the genetically engineered bacterial cell can be further engineered to include a U-sensing regulator genetic molecular component comprising an endogenous or exogenous gene encoding histidine kinase UzcS, and an endogenous or exogenous gene encoding U-sensitive transcriptional response regulator UzcR in a configuration wherein the a gene encoding histidine kinase UzcS, and a gene encoding response regulator UzcR are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding, encoding a fluoride efflux pump are preferably knocked out. In some embodiments of the $UO_2F_2$-biosensors according to the third a fourth and a fifth aspect wherein the $UO_2F_2$-biosensor comprises a U-sensing genetic molecular component in which a U-sensitive promoter comprising a UzcR binding site, the genetically modified bacterial cell is a bacterial cell capable of natively expressing MarR family repressors such as $marR_1$ (CCNA_03498) and $marR_2$ (CCNA_02298) genes (e.g. proteobacteria, such as certain alpha proteobacteria, beta proteobacteria and/or gamma proteobacteria identifiable by a skilled person upon reading of the present disclosure). In those embodiments, the bacterial cell is preferably further engineered to knock out at least one endogenous MarR family repressors such as $marR_1$ and $marR_2$ genes to provide an amplified $UO_2F_2$-biosensor configured to provide an amplified signal following activation of the $UO_2F_2$-sensitive genetic circuit.

In some preferred embodiments of the $UO_2F_2$-biosensor s according to the third a fourth aspect and a fifth aspect wherein the $UO_2F_2$-biosensor comprises a U-sensing genetic molecular component in which a U-sensitive promoter comprises a UzcR binding site, the $UO_2F_2$-biosensor or the U-sensitive F sensitive genetic circuit, further comprises an amplifier genetic molecular component comprising a U-sensitive promoter and UzcY and/or UzcZ in a configuration wherein the U-sensitive promoter directly initiates expression of the amplifier molecular component.

According to a sixth aspect, a method to provide a $UO_2F_2$-biosensor is described, the method comprising genetically engineering a bacterial cell capable of natively and/or heterologously expressing histidine kinase 1363 (UrpS) and/or histidine kinase UzcS, and U sensitive response regulator 1362 (UrpR) and/or U sensitive response regulator UzcR in combination with a heterologous F-sensing riboswitch, the genetically engineering performed by introducing into the cell one or more U-sensing genetic molecular components configured to report and/or neutralize U herein described, an F-sensitive riboswitch within the one or more U-sensing genetic molecular components configured to report U, an F-sensitive riboswitch within an F-sensing reportable genetic molecular component;

one or more genetic molecular components of an F sensitive genetic circuit described herein, and/or one or more genetic molecular components of the U-sensitive F-sensitive genetic circuits described herein, to provide a $UO_2F_2$-biosensor according to the first aspect, the second aspect, the third aspect the fourth aspect, and/or the fifth aspect herein described and optionally operatively connecting the $UO_2F_2$-biosensor so provided to an electronic signal transducer adapted to convert a $UO_2F_2$ biosensor reportable molecular component output into an electronic output.

In some embodiments wherein the bacterial cell is a cell incapable of natively expressing histidine kinase 1363 (UrpS) and response regulator 1362 (UrpR) and/or histidine kinase UzcS and response regulator UzcR, the method further comprises genetically engineering the cell to include a U-sensing regulator genetic molecular component comprising an endogenous or exogenous gene encoding histidine kinase 1363 (UrpS) and/or histidine kinase UzcS, and an endogenous or exogenous gene encoding U-sensitive transcriptional regulator 1362(UrpR) and/or response regulator UzcR in a configuration wherein the a gene encoding histidine kinase 1363 (UrpS) and/or histidine kinase UzcS, and a gene encoding response regulator 1362 (UrpR) response regulator UzcR are expressed upon activation of a controllable promoter.

In some embodiments wherein the bacterial cell is a cell capable of natively expressing histidine kinase 1363 (UrpS) and response regulator 1362 (UrpR) and/or histidine kinase UzcS and response regulator UzcR (e.g. proteobacteria, such as certain alpha proteobacteria, beta proteobacteria and/or gamma proteobacteria identifiable by a skilled person upon reading of the present disclosure), the genetically engineering can preferably further comprises knocking out the natively expressed histidine kinase 1363 (UrpS) and response regulator 1362 (UrpR) and/or histidine kinase UzcS and response regulator UzcR of the bacterial cell, and introducing in the bacterial cell a U-sensing regulator component comprising an endogenous or exogenous gene encoding histidine kinase 1363 (UrpS) and/or histidine kinase UzcS, and an endogenous or exogenous gene encoding U-sensitive transcriptional regulator 1362 (UrpR) and/or response regulator UzcR in a configuration wherein the a gene encoding histidine kinase 1363 and/or histidine kinase UzcS, and a gene encoding response regulator 1362 (UrpR) response regulator UzcR are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding the F-sensing riboswitch, are preferably knocked out.

According to a seventh aspect a $UO_2F_2$-sensing gene cassette described. The $UO_2F_2$-sensing gene cassette comprises one or more U-sensing genetic molecular components herein described, one or more U-sensing regulator genetic molecular components herein described and/or one or more reportable genetic component herein described. The $UO_2F_2$-sensing gene cassette further comprises an F-sensitive riboswitch within the one or more U-sensing genetic molecular components configured to report U, within the one or more U-sensing regulator genetic molecular components and/or within an additional reportable genetic molecular component, in a configuration wherein the U-sensing genetic molecular components, the one or more U-sensing regulator genetic molecular components, and the additional reportable genetic molecular component are transcribed in presence of an effective amount of bioavailable fluoride. In some embodiments the U-sensing gene cassette is an expression cassette. In some embodiments, the gene cassette is comprised within a vector.

According to an eighth aspect a vector is described comprising a polynucleotide encoding for one or more U-sensing genetic molecular components herein described, one or more F-sensing genetic molecular components herein described, one or more U-sensing and/or F sensing regulator genetic molecular components herein described and/or one or more genetic molecular components of a $UO_2F_2$-biosensor herein described. The one or more vectors are configured to introduce one or more U-sensitive genetic molecular components, one or more F-sensing genetic molecular components and/or one or more genetic molecular components of a U-sensitive and/or F-sensitive genetic circuit into a bacterial cell of a plurality of bacterial cells.

According to a ninth aspect, a $UO_2F_2$-sensing system is described. The $UO_2F_2$ sensing system comprises one or more vectors herein described and/or a plurality of bacterial cells natively and/or heterologously expressing histidine kinase 1363 (UrpS) and response regulator 1362 (UrpR) and/or histidine kinase UzcS and response regulator UzcR in combination with one or more F-sensitive riboswitches.

In some embodiments wherein the bacterial cell is a cell incapable of natively expressing histidine kinase 1363 (UrpS) and response regulator 1362 (UrpR) and/or histidine kinase UzcS and response regulator UzcR, the bacterial cell is further genetically engineered to include a U-sensing regulator genetic molecular component comprising an endogenous or exogenous gene encoding histidine kinase 1363(UrpS) and/or histidine kinase UzcS, and an endogenous or exogenous gene encoding U-sensitive transcriptional regulator 1362(UrpR) and/or response regulator UzcR in a configuration wherein the a gene encoding histidine kinase 1363(UrpS) and/or histidine kinase UzcS, and a gene encoding response regulator 1362 (UrpR) response regulator UzcR are expressed upon activation of a controllable promoter.

In some embodiments wherein the bacterial cell is a cell capable of natively expressing histidine kinase 1363 (UrpS) and response regulator 1362 (UrpR) and/or histidine kinase UzcS and response regulator UzcR (e.g. proteobacteria, such as alphaproteobacteria, beta proteobacteria and/or gamma proteobacteria), the bacterial cells is preferably further genetically engineered to comprises knocking out the natively expressed histidine kinase 1363 (UrpS) and response regulator 1362 (UrpR) and/or histidine kinase UzcS and response regulator UzcR of the bacterial cell, and introducing in the bacterial cell a U-sensing regulator component comprising an endogenous or exogenous gene encoding histidine kinase 1363 (UrpS) and/or histidine kinase UzcS, and an endogenous or exogenous gene encoding U-sensitive transcriptional regulator 1362(UrpR) and/or response regulator UzcR in a configuration wherein the a gene encoding histidine kinase 1363 and/or histidine kinase UzcS, and a gene encoding response regulator 1362(UrpR) response regulator UzcR are expressed upon activation of a controllable promoter.

In some embodiments, the genetically modified bacteria are bacteria incapable of natively expressing an F-sensing riboswitch (e.g. *Caulobacter crescentus*) identifiable by a skilled person upon reading of the present disclosure). In some embodiments, the genetically modified bacteria are bacteria capable of natively expressing an F-sensing riboswitch (e.g. *Sphingomonas* sp. MM-1, and *Caulobacterales bacterium*) identifiable by a skilled person upon reading of the present disclosure). In some of those embodiments, the endogenous genes encoding the F-sensing riboswitch, are preferably knocked out.

According to a tenth aspect, a $UO_2F_2$-sensing system is described. The system comprises one or more of the $UO_2F_2$ biosensors herein described operatively connected to an electronic signal transducer adapted to convert a U biosensor reportable molecular component output into an electronic output.

According to an eleventh aspect, a composition is described. The composition comprises one or more $UO_2F_2$ biosensors, $UO_2F_2$-sensing gene cassettes and/or vectors herein described together with a suitable vehicle.

According to a twelfth aspect, a system comprising an electronic signal transducer adapted to convert a $UO_2F_2$ biosensor reportable molecular component output into an electronic output is described. The system comprises an electronic signal transducer and one or more $UO_2F_2$ biosensors herein described operatively connected to the electronic signal transducer.

According to a thirteenth aspect, a method of detecting, reporting and/or neutralizing bioavailable $UO_2F_2$ is described. The method comprises:

contacting one or more $UO_2F_2$ biosensors herein described, or a system comprising an electronic transducer operatively connected to one or more $UO_2F_2$ biosensors herein described, with a target environment comprising one or more target ranges of U concentration in combination with one or more target F concentration for a time and under conditions to detect, report and/or neutralize bioavailable $UO_2F_2$ in the target environment.

According to a fourteenth aspect, one or more $UO_2F_2$-sensing genetic reportable components are also described, the $UO_2F_2$ sensing genetic reportable components comprising a U sensitive promoter comprising a U-sensitive 1362 (UrpR) binding site and/or a U sensitive promoter comprising a U sensitive UzcR binding site together with an F-sensing riboswitch, in a configuration wherein the U-sensitive promoter directly initiates expression of the U-sensing reportable molecular component and/or of the U-sensing U-neutralizing molecular component in presence of bioavailable U and the U-sensing reportable molecular component is transcribed in presence of an effective amount of bioavailable fluoride.

According to a fifteenth aspect, one or more U-sensitive and/or F sensitive genetic circuits are described wherein at least one molecular component is a U sensing genetic molecular component herein described and wherein at least one molecular component is a reportable molecular component, and/or a U-neutralizing molecular component (and in particular possibly one or more U-neutralizing genetic molecular components), The U-sensitive and/or F sensitive genetic circuits further comprises an F-sensing riboswitch within at least one of the genetic molecular components of the genetic circuit in a configuration wherein the at least one of genetic molecular components of the genetic circuit is transcribed in presence of an effective amount of bioavailable fluoride.

In the U-sensitive and/or F-sensitive genetic circuit the reportable molecular component and/or the U-neutralizing molecular component are expressed when the genetic circuit operates according to the circuit design in presence of bioavailable U and/or bioavailable Fluoride.

In particular, in several embodiments the biosensors and related genetic molecular components, genetic circuits, compositions, methods and systems herein described are configured for selective and sensitive detection, reporting and/or neutralizing $UO_2F_2$ a bioavailable environmental decomposition product of $UF_6$ and toxic form of U typically produced during enrichment operations.

The $UO_2F_2$ biosensors, and related genetic molecular components, genetic circuits, compositions, methods and systems herein described provide in several embodiments a selective, sensitive, portable, easy to use, high-throughput measurement and or neutralizing bioavailable $UO_2F_2$, with little or no sample preparation required.

The $UO_2F_2$ biosensors, and related genetic molecular components, genetic circuits, compositions, methods and systems herein described allow in several embodiments construction of consolidated bioremediators comprising bacterial systems that possess all the necessary components for deployment in environmental cleanup efforts, for example by coupling $UO_2F_2$ sensing with activation of one or more U-neutralizing components.

The $UO_2F_2$ biosensors, and related genetic molecular components, genetic circuits, compositions, methods and systems herein described allow in several embodiments detection, reporting and/or neutralization of U in its bioavailable form $UO_2F_2$ with low cost approaches as various proteobacterial cells, such as Caulobacter, can be inexpensively grown to high densities as will be understood by a skilled person.

The $UO_2F_2$ biosensors, and related genetic molecular components, genetic circuits, compositions, methods and systems herein described can be used in connection with various applications wherein detection and/or neutralizing of uranium is desired. For example, the $UO_2F_2$ biosensors, and related genetic molecular components, genetic circuits, compositions, methods and systems herein described can be used in biodefense and in particular to be used for non-proliferation purposes, in environmental monitoring and/or cleanup by regulatory agencies or communities, and in mining in particular for toxicology and safety concerns, as well as diagnostic applications. Additional exemplary applications include uses of the $UO_2F_2$ biosensors, and related genetic molecular components, genetic circuits, compositions, methods and systems herein described in several fields including basic biology research, applied biology, bio-engineering, medical diagnostics, and in additional fields identifiable by a skilled person upon reading of the present disclosure.

The details of one or more embodiments of the disclosure are set forth in the accompanying drawings and the description below. Other features, objects, and advantages will be apparent from the description and drawings, and from the claims.

BRIEF DESCRIPTION OF THE DRAWINGS

The accompanying drawings, which are incorporated into and constitute a part of this specification, illustrate one or more embodiments of the present disclosure and, together with the detailed description and the examples, serve to explain the principles and implementations of the disclosure.

FIG. 4 Panel C shows a schematic of a U-sensitive genetic circuit where a negative feedback loop was incorporated into the circuit, whereby UzcR represses its own expression from $P_{phyt}$ or $P_{1361}$. Specifically, an m_5 UzcR binding site was placed downstream of the $P_{phyt}$ or $P_{1361}$ transcription start site. This genetic circuit shows minimized basal expression of uzcRS, while maintaining strong responsiveness to U, and further shifted ratio of U response to that of Zn to 5.5 as shown in FIG. 5 Panel C.

FIG. 5 Panel A shows graphs reporting quantification of GFP fluorescence produced by *C. crescentus* NA1000 comprising the U-sensitive genetic circuit shown in FIG. 4 Panel A in response to exposure to 10 and 20 µM U (FIG. 5 Panel A left graph), 10, 20 and 40 µM Zn (FIG. 5 Panel A middle graph), or 80, 120 and 200 µM Cu (FIG. 5 Panel A right graph), from 0 to 4 hours after exposure. FIG. 5 Panel B shows graphs reporting quantification of GFP fluorescence produced by *C. crescentus* NA1000 comprising the U-sensitive genetic circuit shown in FIG. 4 Panel B in response to exposure to 10 and 20 µM U (FIG. 5 Panel B left graph), 10, 20 and 40 µM Zn (FIG. 5 Panel B middle graph), or 80, 120 and 200 µM Cu (FIG. 5 Panel B right graph), from 0 to 4 hours after exposure. FIG. 5 Panel C shows graphs reporting quantification of GFP fluorescence produced by *C. crescentus* NA1000 comprising the U-sensitive genetic circuit shown in FIG. 4 Panel C in response to exposure to 10 and 20 µM U (FIG. 5 Panel C left graph), 10, 20 and 40 µM Zn (FIG. 5 Panel C middle graph), or 80, 120 and 200 µM Cu (FIG. 5 Panel C right graph), from 0 to 4 hours after exposure. $P_{phyt}$ was used for the GFP fluorescence measurements shown in FIG. 5 Panels B-C. Experiments with U were performed in modified M5G medium (10 mM PIPES, pH 7, 1 mM NaCl, 1 mM KCl, 0.05% $NH_4Cl$, 0.01 mM Fe/EDTA, 0.2% glucose, 0.5 mM $MgSO_4$, 0.5 mM $CaCl_2$) supplemented with 5 mM glycerol-2-phosphate as the phosphate source (M5G-G2P). Cells were grown to mid-exponential phase in M5G-G2P media, washed once with fresh media, then resuspended in fresh media containing the indicated U concentration. Experiments with Zn and Cu were performed in PYE.

FIG. 6A shows a schematic of an exemplary 'in parallel' AND gate, comprised of an HRP AND gate system, in which hrpS is placed under the control of $P_{phyt}$ or $P_{1361}$ and hrpR is placed under the control of $P_{urcB}$, a promoter activated by UzcRS. In this U-sensitive genetic circuit, U exposure stimulates production of both HrpS and HrpR, leading to activation of $P_{hrpL}$ and expression of GFP. FIG. 6B shows a schematic of an exemplary 'in parallel' AND gate, comprised of a tripartite GFP system, in which gfp10 subunit is placed under the control of $P_{phyt}$ or $P_{1361}$, gfp11 is placed under the control of $P_{urcB}$, and gfp1-9 is placed under the control of the *Caulobacter* S layer promoter, $P_{rsaA}$, which is a strong, constitutive promoter [4]. This system requires expression of subunits gfp10, gfp11 and gfp1-9 for tripartite GFP reporter assembly and fluorescence. Gfp-10 is shown fused to K1 and gfp11 is shown fused to E1, wherein K1 and E1 are exemplary interacting protein partners comprised of oppositely charged coiled-coils [5]. When K1 and E1 interact, GFP10 and GFP11 self-associate with GFP1-9 to constitute a functional GFP reporter. Other exemplary embodiments of the genetic circuit shown in FIG. 6B comprise placement of gfp1-9 under the control of $P_{phyt}/P_{1361}$, or under the control of a different non-U-sensitive promoter, such as $P_{xyl}$ that is responsive to xylose [6]. In addition.

FIG. 7 shows schematics of regulatory sequences within $P_{phyt}$ (FIG. 7 Panel A), showing the sequence CCCAAAGAGGGTGTGGCCCAAAGAGGGTGTGGAT-TTCTCTTCGCGCCACCCGTTTCG TCAGCCGGACG-TCAGGTCCAGACGGCTAAGCTAGCTGCGA (SEQ ID NO: 202) and $P_{1361}$ (FIG. 7 Panel B), showing the sequence ATGTTCAGCGCCTGGTTACCGGCGATGGCGCG-GTGTCAGCGTTCGGGCGTTGCGATG CGTCAG-GAGCGTGTCAGGATGCCTGTGGAATCCTAAGCGC (SEQ ID NO: 203) with arrows above nucleotides indicating putative transcription start sites. In FIG. 7 Panel C, a phylogenetic footprinting approach was used to construct a 1362 DNA-binding motif. An alignment of 26 $P_{phyt}$ or $P_{1361}$ DNA sequences from exemplary members of the subclass Caulobacteridae, Bradyrhizobiaceae, Sphingomonadaceae, Hyphomicrobiaceae, and Rhodobacteracea are indicated, with larger letters representing a higher level of consensus between aligned sequences.

FIG. 8 shows DNA sequences of full-length $P_{phyt}$ (Panel A), $P_{phyt}$ with a mutation of four nucleotides in the second direct repeat sequence (DR2, shown in bold, Panel B), $P_{phyt}$ with a mutation of two nucleotides in the first direct repeat sequence (DR1, shown in bold, Panel C), $P_{phyt}$ with a mutation of two nucleotides in the second direct repeat sequence (DR2, shown in bold, Panel D), a shortened $P_{phyt}$ ($P_{phyt}$ short, Panel E), full-length $P_{1361}$ (Panel F), $P_{1361}$ with a mutation of four nucleotides in the second direct repeat sequence (DR2, shown in bold, Panel G), $P_{1361}$ with a mutation of two nucleotides in the second direct repeat sequence (DR2, shown in bold, Panel H), and a shortened $P_{1361}$ ($P_{1361}$ short, Panel I). The sequence of the large tandem repeat (TR) in $P_{phyt}$ is shown in uppercase, underlined. The direct repeat sequence that is likely bound by the U-sensitive transcriptional response regulator 1362 is shown in uppercase, italic (with direct repeat sequences underlined). Putative Transcription start sites (based on RNA-seq data) are shown in lowercase, underlined.

In FIG. 9 Panel A, fluorescence levels are shown for variants comprising full length $P_{phyt}$ promoter (Full length), a shortened $P_{phyt}$ (Short), $P_{phyt}$ with a mutation of four nucleotides in the second direct repeat sequence (DR2 GTCA→CAGT), $P_{phyt}$ with a mutation of two nucleotides in the first direct repeat sequence (DR1, GT→CA), and $P_{phyt}$ with a mutation of two nucleotides in the second direct repeat sequence (DR2, GT→CA). In FIG. 9 Panel B, fluorescence levels are shown for variants comprising full length $P_{1361}$ promoter (Full length), a shortened $P_{1361}$ (Short), $P_{1361}$ with a mutation of four nucleotides in the second direct repeat sequence (DR2 GTCA→CAGT), and $P_{1361}$ with a mutation of two nucleotides in the second direct repeat sequence (DR2, GT→CA). Cells were grown to mid-exponential phase in M5G-G2P media, washed once with fresh media, then resuspended in fresh media containing the indicated U concentration. Fluorescence was quantified following a two-hour exposure of cells to each U concentration and normalized to the $OD_{600}$.

FIG. 16B is from FIG. 2 of Newsome et al. (2014) [7] showing a schematic illustrating exemplary mechanisms of microbe-uranium interactions, such as biomineralisation [14-16].

FIG. 16C is from FIG. 2 of Newsome et al. (2014) [7] showing a schematic illustrating exemplary mechanisms of microbe-uranium interactions, such as biosorption [17, 18].

FIG. 16D is from FIG. 2 of Newsome et al. (2014) [7] showing a schematic illustrating exemplary mechanisms of microbe-uranium interactions, such as bioaccumulation [19] as presented in Newsome et al., (2014) [7].

In FIG. 17 Panels A and B, fluorescence levels are shown for wild type *C. crescentus* and strains deleted for CCNA_01362 (1362 response regulator) and CCNA_01363 (1363 histidine kinase). U induction of both $P_{phyt}$ and $P_{1361}$ is abolished by deletion of either CCNA_01362 (indicated by Δ CCNA_01362) or CCNA_01363 (indicated by Δ CCNA_01363), confirming that these genes encode the U sensitive transcriptional regulatory system required for U-responsive activation of the exemplary promoters $P_{phyt}$ and $P_{1361}$. Cells were grown to mid-exponential phase in M5G-G2P media, washed once with fresh media, then resuspended in fresh media containing the indicated U concentration. Fluorescence was quantified following a two-hour exposure of cells to each U concentration and normalized to the $OD_{600}$.

FIG. 17 Panel A shows a graph reporting exemplary quantification of GFP fluorescence produced by *C. crescentus* NA1000 comprising the U-sensitive genetic circuit shown in FIG. 6 Panel B upon exposure to U, Zn, Cu and Cd. In this circuit, the expression of gfp10-K1 is initiated by the shortened 1363/1362-regulated $P_{phyt}$ (Pphyt-short) and the expression of E1-gfp11 is initiated by the UzcRS-regulated promoter $P_{urcB}$. FIG. 17 Panel B shows a graph reporting exemplary quantification of GFP fluorescence produced by *C. crescentus* NA1000 comprising a control U-sensitive genetic circuit that incorporates input only from UzcRS. FIG. 17 demonstrates the enhanced selectivity of an exemplary 'in parallel' AND gate comprising two points of U-sensing by (1) 1363/1362 and (2) UzcRS two component systems. Cells were grown to mid-exponential phase in M5G-G2P media, washed once with fresh media, then resuspended in fresh media containing the indicated metal concentration. Fluorescence was quantified following a three-hour exposure of cells to each metal concentration and normalized to the $OD_{600}$.

FIG. 37 Panel B shows the curves for the Corse Sensor, constitutive uzcY and $P_{phyt}$ uzcY. Fluorescence was quantified following a three-hour exposure to a range of metal concentrations. The data represent a zoomed in version of data depicted in FIG. 40 and FIG. 36C. Error bars represent the average of biological triplicates.

(FIG. 38 Panel A) Fluorescence output of the core sensor and control variants lacking critical regulatory components as a function of time in three distinct site 300 samples without nutrient supplementation. (FIG. 38 Panel B) Fluorescence output of the core sensor and a control strain lacking a UrpR binding site as a function of time in three distinct site 300 samples supplemented with glucose (0.2%), orthophosphate (1 mM), and ammonium chloride (0.05%). The plot legend is depicted below the plots.

FIG. 39 Panel A: Fluorescence output of the core sensor and control variants lacking critical regulatory components as a function of time in three distinct site 300 samples supplemented with glucose (0.2%), glycerol-2-phosphate (5 mM), and ammonium chloride (0.05%). Ground water samples from W-815-2621, W-812-01, and W-6C are referred to as 1, 2, and 3, respectively, in the text. The plot legend is depicted below the plots. FIG. 39 Panel B: The fluorescence of the core sensor and control variants was quantified six hours after exposure to site 300 samples supplemented with uranyl nitrate and the nutrients described in panel A. The x-axis concentrations represent the total U concentration in the ground water sample after addition of U in 1 µM increments.

FIG. 46 shows a schematic representation of exemplary single output configurations of a $UO_2F_2$ biosensor herein described. In particular FIG. 46 Panel A describes a schematic of uranium- and fluoride-sensing components integrated in series. The promoter can be any UzcR- or UrpR-regulated promoter (defined in prior patent app) such that U-dependent transcription is initiated by UzcR or UrpR. In this circuit, transcription will be prematurely terminated by the fluoride sensing riboswitch in the absence of fluoride (i.e., not detectable output). Binding of fluoride to the riboswitch will mediate transcriptional read-through and ultimately, production of the reporter. FIG. 46 Panel B describes a schematic of uranium- and fluoride-sensing components integrated in series where U-dependent transcriptional activation requires the function of both UrpR and UzcR. This sensor will provide greater selectivity for uranium compared to the sensors described in panel A. However, in this configuration, the sensitivity for U would be limited by the UzcRS component. FIG. 46 Panel C describes a schematic of the integration of the fluoride riboswitch within the AND gate circuit such that expression of component three requires fluoride exposure. In this configuration, reconstitution of GFP fluorescence requires activation of the two uranium-responsive pathways and fluoride binding to the fluoride riboswitch. Transcription of component three can theoretically be controlled by any constitutive promoter. The assignment of each component with the given regulatory promoter is arbitrary and easily swapped. For example, the fluoride riboswitch could be used to control expression of component one or two.

FIG. 49 panel A reports results showing growth in *Caulobacter crescentus* WT at NaF concentrations above 4 mM and FIG. 49 panel B reports results showing growth in *Caulobacter crescentus* ΔcrcB at NaF concentrations above 126.5 µM. FIG. 49 panel C reports results showing growth in *Caulobacter crescentus* WT at NaCl concentrations above 4 mM. FIG. 49 panel D reports results showing growth in *Caulobacter crescentus* ΔcrcB at NaCl concentrations above 4 mM.

FIG. 50 shows a schematic and charts illustrating the result of testing the function of fluoride riboswitches from three different bacteria in *Caulobacter crescentus*. FIG. 50 Panel A shows a schematic configuration of the exemplary construct used to perform the testing using 3-galactosidase as a reporter. FIG. 50 Panel B shows a chart reporting the β-galactosidase activity for the *Sphingomonas* MM-1 in WT and the crcB deletion strain over a range of NaF concentrations FIG. 50 Panel C shows a chart reporting the β-galactosidase activity for the *Pseudomonas syringae* riboswitch in WT and the crcB deletion strain over a range of NaF concentrations and FIG. 50 Panel D shows a chart reporting the β-galactosidase activity for the *Sphingomonas* 67-36 riboswitch in WT and the crcB deletion strain over a range of NaF concentrations.

FIG. 51 Panel A shows a schematic representation of a construct wherein each of three tested riboswitches was included in construction between to the xylose inducible promoter (Pxyl) and the reporter mCherry. FIG. 51 Panel B shows a chart reporting the effect of xylose administration ad different concentration on promoter activity. FIG. 51 Panel C shows a chart reporting the effect of 200 uM xylose administration on mCherry expression in the constructs including each of the three riboswitches as indicated. FIG. 51 Panel D shows a chart reporting the effect of 2 mM xylose administration on mCherry expression in the constructs including each of the three riboswitches as indicated. FIG. 51 Panel E shows a chart reporting the effect of 200 uM xylose administration on mCherry expression in the constructs including the *Sphingomonas* MM-1 fluoride riboswitch in C. *Crescentus* WT and C. *Crescentus* with a crcB deletion. FIG. 51 Panel F shows a chart reporting the effect of 2 mM xylose administration on mCherry expression in the constructs including the *Sphingomonas* MM-1 fluoride riboswitch in C *Crescentus* WT and C. *Crescentus* with a crcB deletion.

FIG. 53 shows an alignment of RNA polynucleotides encoded by 287 sequences (SEQ ID NO: 1989-1998 and SEQ ID NO: 2232 to SEQ ID NO: 2508) from the 2017 exemplary F-sensing riboswitch sequences shown in Appendix I of U.S. provisional application No. 62/801,077 (SEQ ID NO: 205-1988 and SEQ ID NO: 1999-2231), wherein the nucleotide sequences shown are sequences forming a same structure in corresponding aligned sequences and the symbols "- -" indicates gaps between the aligned sequences shown.

FIG. 55 Panel A shows fluoride detection performed with a control, MM-1 fluoride sensing circuit with native crcB promoter not responsive to U. FIG. 55 Panel B shows fluoride detection performed with a uranyl fluoride sensing circuit constructed by combining the UrpRS-responsive Pphyt promoter with the MM-1 riboswitch. FIG. 55 Panel C shows the fluorescence of the uranyl fluoride sensing circuit in the presence of U alone, F alone, and both U and F. Tests-were performed with F—, added as NaF, and uranyl added as uranyl nitrate.

APPENDIX I—U.S. APPLICATION NO. 62/801,077

Figure 1:
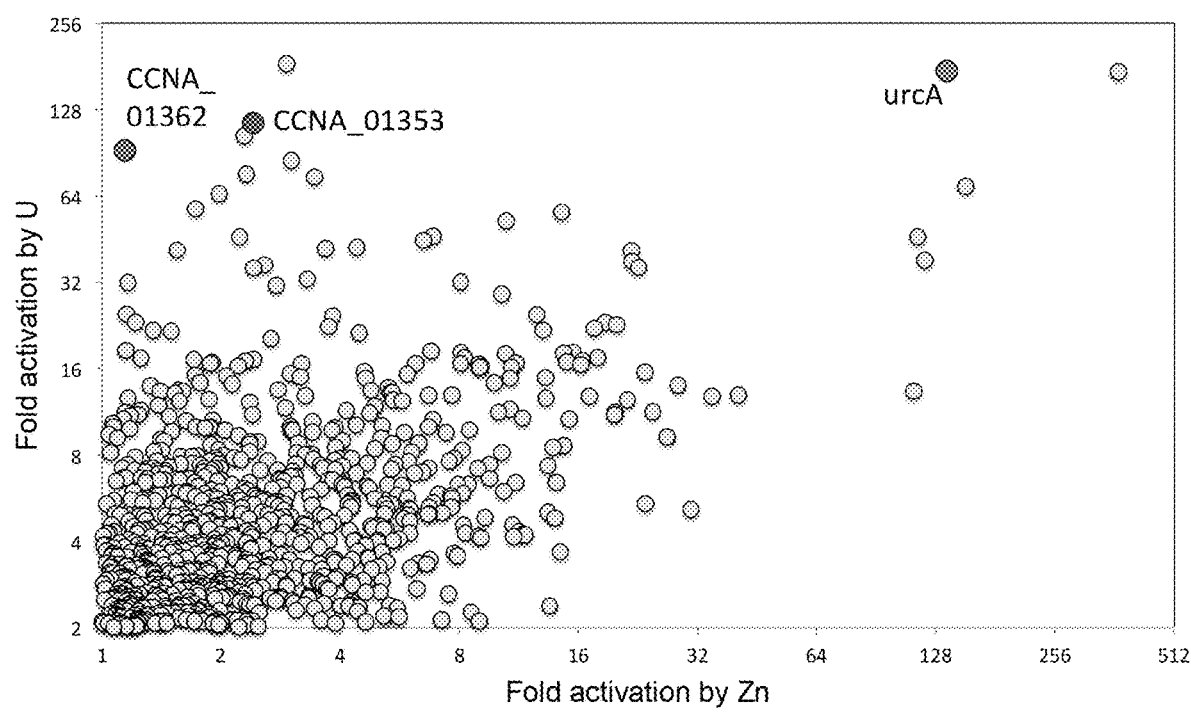
FIG. 1 shows a graph of pairwise comparison of fold-change in expression in Caulobacter crescentus of exemplary genes activated by Zn or U, analyzed using RNA-Seq. CCNA_01362 and CCNA_01353 (phytase) (dark grey data points shown as respectively labeled circles) are induced more than 100-fold by U but not induced by Zn. As such, the promoters regulating these genes, $P_{1361}$ and $P_{1353}$ ($P_{phyt}$) respectively, represent promising exemplary promoters for use in a whole-cell U biosensor. urcA (dark grey data point indicated as labeled circle), a gene regulated by UzcRS (FIG. 24A-C), is strongly induced by both U (FIG. 24A) and Zn (FIG. 23A).

Appendix I of U.S. provisional application No. 62/801,077, which is incorporated into and constitute a part of this specification, illustrates one or more fluoride sensing riboswitch that can be used in any one of the $UO_2F_2$ biosensors of the present disclosure which are also reported in the enclosed Sequence Listing from SEQ ID NO: 205 to SEQ ID NO: 1988 and SEQ ID No: 1999 to SEQ ID NO: 2231. In particular the sequences from Appendix I U.S. provisional application No. 62/801,077, and the Sequences from SEQ ID NO: 205 to SEQ ID NO: 1988 and SEQ ID No: 1999 to SEQ ID NO: 2231 of the Sequence Listing of the instant application, are sequences from Rfam database reported with their related Genome file ID, bacteria and additional information concerning the position of the sequence in the genome of the bacteria as will be understood by a skilled person. Appendix I of U.S. provisional application No. 62/801,077 and the Sequence Listing enclosed herewith, together with the detailed description section, the Example section and the Drawings, serve to explain the principles and implementations of the disclosure. Other features, objects, and advantages will be apparent from the entire description and drawings, and from the claims.

DETAILED DESCRIPTION

Provided herein are $UO_2F_2$ biosensors and related U-sensing and/or F sensing genetic molecular components, genetic circuits, compositions, methods and systems which in several embodiments can be used to detect, report and/or neutralize U and in particular bioavailable Uranium which is produced in connection with enrichment programs $UO_2F_2$.

The term "bioavailable" as used herein refers to a molecule in particular a soluble molecule that is able to cross an organism's cellular membrane from the environment, or is otherwise able to exert a biological effect on an organism, if the organism has access to the molecule. In particular, with regard to a toxic molecule, a bioavailable toxic molecule is a toxic molecule that is able to exert toxicity on an organism contacted with the organism and/or with a toxic molecule sensing system of the organism. In some scenarios, the bioavailability can be inferred based on toxicity or activation of a tress response in an organism as will be understood by a skilled person. Thus, the term "bioavailable U" as used herein refers to a soluble molecular form of U that can cross an organism's cellular membrane from the surrounding environment or is otherwise able to exert a biological effect on an organism, e.g. following contact with the organism and/or with an organism U-sensing system.

In particular, the term "bioavailable uranium" comprises uranyl ion, which has a linear structure with short U—O bonds, indicative of the presence of multiple bonds between uranium and oxygen and can bind four or more ligands in an equatorial plane. The uranyl ion forms many complexes, particularly with ligands that have oxygen donor atoms. Complexes of the uranyl ion are important in the extraction of uranium from its ores and in nuclear fuel reprocessing. As would be understood by persons skilled in the art, 'naked' or 'uncomplexed' uranyl oxycation is a bioavailable form of U. In contrast, for example, uranyl oxycation complexed with inorganic phosphate is not considered to be bioavailable.

The term "uranyl oxycation" as used herein refers to the predominant form of U in oxygenated environments, comprising the +6 oxidation state ($UO_2^{+2}$.), which has high chemical toxicity [24]. The US Environmental Protection Agency's maximum contaminant limit for U in drinking water is 30 μg/L (~0.13 μM), however, groundwater concentrations in the US frequently exceed this limit [25, 26].

The $UO_2F_2$ biosensors and related U-sensing and/or F-sensing genetic molecular component, gene cassettes, genetic circuits, compositions, methods and systems described herein can be used in several embodiments to detect and report and/or neutralize bioavailable U, and in particular $UO_2F_2$ which is a derivative of $UF_6$.

The term "$UF_6$" or "uranium hexafluoride" as used herein indicates is a compound used in the process of enriching uranium, which produces fuel for nuclear reactors and nuclear weapons. In particular Uranium hexafluoride ($UF_6$) is almost always produced as a precursor in any U-enrichment operation, is routinely released during the conversion process, and is not expected to occur naturally in the environment [27, 28] As such, environmental detection of $UF_6$—or the more stable hydrolysis product $UO_2F_2$, which is rapidly formed when atmospheric $UF_6$ reacts with water vapor [29]. does strongly suggest an enrichment program.

In particular, conversion facilities, which produce the $UF_6$ precursor that is almost always required for the production of highly enriched uranium, represent a likely source of leaked $UF_6$ as a consequence of the higher-than atmospheric pressures employed. [27, 28]

When gaseous $UF_6$ is released into the atmosphere, it is rapidly hydrolyzed by ambient moisture to form an $UO_2F_2$ aerosol (and HF gas) that is dispersed and ultimately deposited on vegetation, soil, or an aquatic system [29, 30]. $UO_2F_2$ is expected to have reasonable stability in the environment such that its detection may be feasible for months after release [27, 31].

$UO_2F_2$ aerosols, which are rapidly formed when atmospheric $UF_6$ reacts with water vapor [29], are expected to be deposited on vegetation, soil, or into aquatic systems [29, 30]. While $UO_2F_2$ aerosols are expected to have reasonable stability in low moisture environments [27, 31], $UO_2F_2$ exhibits relatively high solubility in aqueous environments (up to 2 M [32]);

A solution-based detection approach is therefore expected to be most relevant for $UO_2F_2$ monitoring in aquatic systems or when coupled with a sampling device that collects and solubilizes $UO_2F_2$ aerosols. Additionally, the rationale for separate uranium and fluoride detection components is supported by the solution chemistry of $UO_2F_2$ and prior studies on bacterial uranium interactions.

The physicochemical form, or speciation, of $UO_2F_2$, is dependent on the geochemical conditions [33, 34]. In particular, at pH below 5, the naked uranyl oxycation ($UO_2^{2+}$) and uranyl fluoride species ($UO_2F^+$, $UO_2F_2$, $UO_2F_3^-$) are expected to predominate [33]. At circumneutral (6.5-7.5) and alkaline pH, uranyl hydroxide and/or carbonate species are expected to predominate with concomitant formation of the anion, $F^-$ [33, 34]. Under those conditions, uranium and fluoride are expected to largely exist as separate species under geochemical conditions most relevant to aqueous environmental sampling (pH 6-8 range).

In addition, studies of bacterial uranium interactions suggest that cell surface functional groups could have a dissociative effect on uranyl fluoride species, yielding detectable forms of both components; cell surface functional groups have been shown to compete with environmental ligands (e.g., carbonate and citrate) for uranyl coordination, effectively freeing the coordinating ligand [35, 36].

Insoluble forms of uranyl—for example uranyl phosphate minerals formed when uranyl nitrate is added to solutions containing high orthophosphate levels—are not detected by the biosensor. This is an advantageous feature for environmental detection since natural U commonly occurs in the form of insoluble U minerals [37] and aqueous phosphate concentrations are typically very low (<10 ppb) [34].

$UO_2F_2$ biosensor herein described are bacteria-based $UO_2F_2$-sensor, which are engineered to comprise a fluoride-sensing riboswitch in combination a U-sensing genetic molecular components, U neutralizing genetic molecular component, reportable genetic molecular components, and/or additional components possibly configured in genetic circuits directed to detect and/or neutralize U in presence of bioavailable Uranium and Fluoride.

In particular, the $UO_2F_2$ biosensors herein described are whole-cell biosensors comprising a genetically engineered bacterial cell.

The term "bacterial cell", bacteria" used herein interchangeably with the terms "cell" or "host" indicates a large domain of prokaryotic microorganisms. The term "prokaryotic" is used herein interchangeably with the terms "cell" or "host" and refers to a microbial species which contains no nucleus or other organelles in the cell. Exemplary prokaryotic cells include bacteria. Typically, a few micrometers in length, bacteria have a number of shapes, ranging from spheres to rods and spirals, and are present in several habitats, such as soil, water, acidic hot springs, radioactive waste, the deep portions of Earth's crust, as well as in symbiotic and parasitic relationships with plants and animals. Bacteria in the sense of the disclosure refers to several prokaryotic microbial species which comprise Gram-positive bacteria, Proteobacteria, Cyanobacteria, Spirochetes and related species, Planctomyces, *Bacteroides, Flavobacteria, Chlamydia*, Green sulfur bacteria, Green non-sulfur bacteria including anaerobic phototrophs, *Radioresistant micrococci* and related species, *Thermotoga* and *Thermosipho thermophiles* as would be understood by a skilled person. More specifically, the wording "Gram positive bacteria" refers to cocci, nonsporulating rods and sporulating rods, such as, for example, *Actinomyces, Bacillus, Clostridium, Corynebacterium, Erysipelothrix, Lactobacillus, Listeria, Mycobacterium, Myxococcus, Nocardia, Staphylococcus, Streptococcus* and *Streptomyces.*

The term "proteobacteria" as used herein refers to a major phylum of Gram-negative bacteria. Many move about using flagella, but some are nonmotile or rely on bacterial gliding. As understood by skilled persons, taxonomic classification as proteobacteria is determined primarily in terms of ribosomal RNA (rRNA) sequences. The Proteobacteria are divided into six classes, referred to by the Greek letters alpha through epsilon and the Acidithiobacillia and Oligoflexia, including alphaproteobacteria, betaproteobacteria and gammaproteobacteria as will be understood by a skilled person.

The term "alphaproteobacteria" as used herein refers to bacteria identifiable by those skilled in the art in the phylogenetic Class Alphaproteobacteri, in the Phylum Proteobacteria. As understood by those skilled in the art, Alphaproteobacteria is a diverse taxon and comprises several phototrophic genera, several genera metabolising C1-compounds (e.g., *Methylobacterium* spp.), symbionts of plants (e.g., *Rhizobium* spp.), endosymbionts of arthropods (*Wolbachia*) and intracellular pathogens (e.g. *Rickettsia*). As understood by those skilled in the art, taxonomic classification of alphaproteobacteria can be identified by reference to publicly available online databases such as the List of Prokaryotic names with Standing in Nomenclature (LPSN) and National Center for Biotechnology Information (NCBI) and the phylogeny is based on 16S rRNA-based LTP release 106 by 'The All-Species Living Tree' Project. The Class Alphaproteobacteria is divided into three subclasses Magnetococcidae, Rickettsidae and Caulobacteridae [38]. In particular, the Caulobacteridae is a subclass composed of the orders Holosporales, Rhodospirillales, Sphingomonadales, Rhodobacterales, Caulobacterales, Rhizobhiales, Kiloniellales, Kordiimonadales, Parvularculales and Sneathiellales.

The term "betaproteobacteria" as used herein refers to a class of gram-negative bacteria, and one of the classes of the phylum Proteobacteria. [39] The Betaproteobacteria comprise more than 75 genera and 220 species of bacteria identifiable by persons skilled in the art. [40] Seven orders of betaproteobacteria have been described: Burkholderiales, Hydrogenophilales, Methylophilales, Neisseriales, Nitrosomonadales, Rhodocyclales, and Sulfuricellales. Examples of Betaproteobacteria genera comprise *Bordetella, Ralstonia, Neisseria* and *Nitrosomonas*, among others identifiable by skilled persons. While many Betaproteobacteria identifiable by skilled persons are found in environmental soil and water, others are obligate pathogens and can cause disease in a variety of hosts. Some members of betaproteobacteria can cause disease in various eukaryotic organisms. Several cause diseases in humans, such as members of the genus *Neisseria: N. gonorrhoeae* and *N. meningitides* which cause gonorrhea and meningitis respectively, as well as *Bordetella pertussis* which causes whooping cough. Other members infect plants, such as *Burkholderia cepacia* which causes bulb rot in onions as well as *Xylophilus ampelinus* which causes necrosis of grapevines. [40]

The term "gammaproteobacteria" as described herein refers to a class of gram-negative bacteria, and one of the classes of the phylum Proteobacteria. As would be identifiable by skilled persons, exemplary taxonomic orders, families and genera belonging to the class gammaproteobacteria comprise *Acidithiobacillus*, Xanthomonadales, Chromatiales, *Methylococcus, Beggiatoa*, Legionellales, *Ruthia, Vesicomyosocius, Thiomicrospira, Dichelobacter, Francisella*, Moraxellaceae, *Alcalinovorax, Saccharophagus, Reinekea*, Oceanospirillaceae, *Marinobacter, Pseudomonadaceae, Aeromonas*, Vibrionales, Pasteurellales, and Enterobacteriales among others. A number of bacteria have been described as members of gammaproteobacteria, but have not yet been assigned an order or family. These comprise bacteria of the genera *Alkalimarinus, Alkalimonas, Arenicella, Gallaecimonas, Ignatzschineria, Litorivivens, Marinicella, Methylohalomonas, Methylonatrum, Plasticicumulans, Pseudohongiella, Sedimenticola, Thiohalobacter, Thiohalomonas, Thiohalorhabdus, Thiolapillus*, and *Wohlfahrtiimonas* among others identifiable by skilled persons. Other examples of gammaproteobacteria genera comprise *Escherichia, Shigella, Salmonella, Yersinia, Buchnera, Haemophilus, Vibrio*, and *Pseudomonas*, among others identifiable by skilled persons. Some members of gammaproteobacterial are pathogenic in humans, for example some strains of the species *Salmonella* spp., *Yersinia pestis, Vibrio cholerae, Pseudomonas aeruginosa*, and *Escherichia coli*, among others identifiable by skilled persons. Some members of gammaproteobacteria are pathogenic in plants, such as *Xanthomonas axonopodis* pv. *citri, Pseudomonas syringae* pv. *actinidiae*, and *Xylella fastidiosa*, among others identifiable by skilled persons.

In some embodiments, the $UO_2F_2$ biosensors herein described are whole-cell biosensors comprising a genetically engineered alphaproteobacterial cell of the subclass Caulobacteridae. In particular in some embodiments, the U biosensors described herein can comprise a cell of any genus, species and/or strain of Caulobacteridae identifiable by those skilled in the art. Exemplary Caulobacteridae that can be used in U-biosensors herein described comprise species of the Families Bradyrhizobiaceae, Sphingomonadaceae, Caulobacteraceae, Hyphomicrobiaceae and Rhodobacteraceae which include species naturally comprising, as well as others identifiable by persons skilled in the art.

In particular, in some embodiments, $UO_2F_2$-biosensor s herein described can comprise species from the order Caulobacterales, the family Caulobacteraceae, the genus *Caulobacter* and the species *Caulobacter crescentus* which is described herein as one of the representative species of the subclass Caulobacteridae.

In some embodiments of the $UO_2F_2$-biosensors herein described, the bacterial cell of the U-biosensor is capable of natively and/or heterologously expressing a U-sensitive histidine kinase 1363, and cognate response regulator 1362.

The term "histidine kinase P1363" or "UrpS" as used herein refers to a histidine kinase having the amino acid sequence (SEQ ID NO: 3)
MSGGSLRWRLIVGGMLAILAALAVAWLAMTWLFERHIVRRETADLTR

AGQVLVAGLRLEPNGAPVIDATLSDPRLSKAAGGFYWQVSTTSGSER

SVSLWDQALKPPQTAPAEGWSSRIAAGPFDDRVLLVERSVRPDRDGP

AVLIQVASDEKVLRAARREFGRELAIFLGGLWAILSGAAALQVVLGL

-continued

SPLTRVRADLARLRKSPSARMSLDHPREIAPLAEAINALAEAREADL

ARARRRAGDLAHSLKTPLAALSAQSRRAREDGAVAAADGLDAAIASV

AAALEAELARARAAAAREAVFAAETAPLAVAERLVAVLERTADGERL

IFDIDVPADLKAPASEDVVTEMLGALIENAARHARRQVRISGAVVGQ

GAVLIVEDDGPGLDKGRAEAALARGARLDEAGPGHGLGLAIVRD LA

EASGAVLSMDRGDLGGLRAMVSWTAPGAGP, found in *C. crescentus* NA1000, or a sequence that when aligned with sequence SEQ ID NO: 3 has a BLAST score between 240 and 300, between 300 and 500, or preferably between 500 and 800, or more preferably over 800 but less than 100% homology or even more preferably having a BLAST Score of 851 and 100% homology with the sequence SEQ ID NO: 3.

The term "U sensitive response regulator 1362" or "response regulator 1362" or "UrpR" refers to a response regulator having amino acid sequence (SEQ ID NO: 4)
MMRALVVEDDPVVGPDLAKALSASGFVVDIARDGEDASFKGEVEDYA

LVVLDLGLPRLDGLSVLRRWRANDRAFPVLILSARGDWTEKVEGIEA

GADDYLAKPFEMGELLARARGLVRRAAGRTSPVIGAGRLALDTRRMS

ATLDGAPIRLSPLEFRLLDCLAHNPGRAVSAGELAEQLYGVADTADT

NAIEALVARLRRKIGADVIETR RGFGYLLAGGTA of *C. crescentus* NA1000 or a sequence that when aligned with sequence SEQ ID NO: 4 has a BLAST score between 200 and 250, or preferably between 250 and 300, or more preferably over 300 but less than 100% homology or even more preferably having a BLAST Score of 429 and 100% homology with the sequence SEQ ID NO: 4.

The term "BLAST" or "Basic Local Alignment Search Tool" is an algorithm for comparing primary biological sequence information, such as the amino-acid sequences of proteins or the nucleotides of DNA sequences. A BLAST search enables a researcher to compare a query sequence with a library or database of sequences, and identify library sequences that resemble the query sequence above a certain threshold. Accordingly, BLAST or Basis Local Alignment Search Tool uses statistical methods to compare a DNA or protein input sequence, also referred to as a query sequence to a database of nucleotide and protein (subject sequences) and returns sequences hits that have a level of similarity to the query sequence ranked based on the score.

The term "score" in the context of sequence alignments, indicates a numerical value that describes the overall quality of an alignment. Higher scores correspond to higher similarity and lower scores correspond to lower similarity. The score scale depends on the scoring system used for conducting the sequence alignment.

A BLAST score, also referred to as bit score or max score in the BLAST output is a normalized score with respect to the scoring system provided by the BLAST algorithm. The BLAST score defines the highest alignment score of a set of aligned segments from the same subject (database) sequences. The score is calculated from the sum of the match rewards and the mismatch, gap open an extend penalties independently for each segment. The BLAST score normally gives the same sorting order as the expect value (E value) in the BLAST alignment output.

A BLAST score can be obtained using BLAST software suite at the NCBI website and related references and in particular at the website https://blast.ncbi.nlm.nih.gov/Blast.cgi?PROGRAM=blastp&PAGE_TYPE=Blast-Search&LINK_LOC=blasthome at the date of filing of the present disclosure, as will be understood to a person skilled in the art.

In embodiments herein described the "histidine kinase P1363" or "UrpS" and the "response regulator 1362" or "UrpR" typically form a two-component system herein also indicated as "1363/1362 TCS", UrpRS TCS" or "UrpRS".

The term "two component system" as used herein refers to a stimulus-response coupling mechanism that allows organisms to sense and respond to changes in many different environmental conditions [41]. Two-component systems typically consist of a membrane-bound histidine kinase that senses a specific environmental stimulus and a corresponding response regulator that mediates the cellular response, mostly through differential expression of target genes [42]. Although two-component signaling systems are found in all domains of life, they are most common in bacteria, particularly in Gram-negative and cyanobacteria [43]. Two-component systems accomplish signal transduction through the phosphorylation of a response regulator (RR) by a histidine kinase (HK). Histidine kinases are typically homodimeric transmembrane proteins containing a histidine phosphotransfer domain and an ATP binding domain. Response regulators can consist only of a receiver domain, but usually are multi-domain proteins with a receiver domain and at least one effector or output domain, often involved in DNA binding [43]. Upon detecting a particular change in the cellular environment, the HK performs an autophosphorylation reaction, transferring a phosphoryl group from adenosine triphosphate (ATP) to a specific histidine residue. The cognate response regulator (RR) then catalyzes the transfer of the phosphoryl group to an aspartate residue on the response regulator's receiver domain [44, 45]. This typically triggers a conformational change that activates the RR's effector domain, which in turn produces the cellular response to the signal, usually by activating or repressing expression of target genes [43].

Figure 3A:
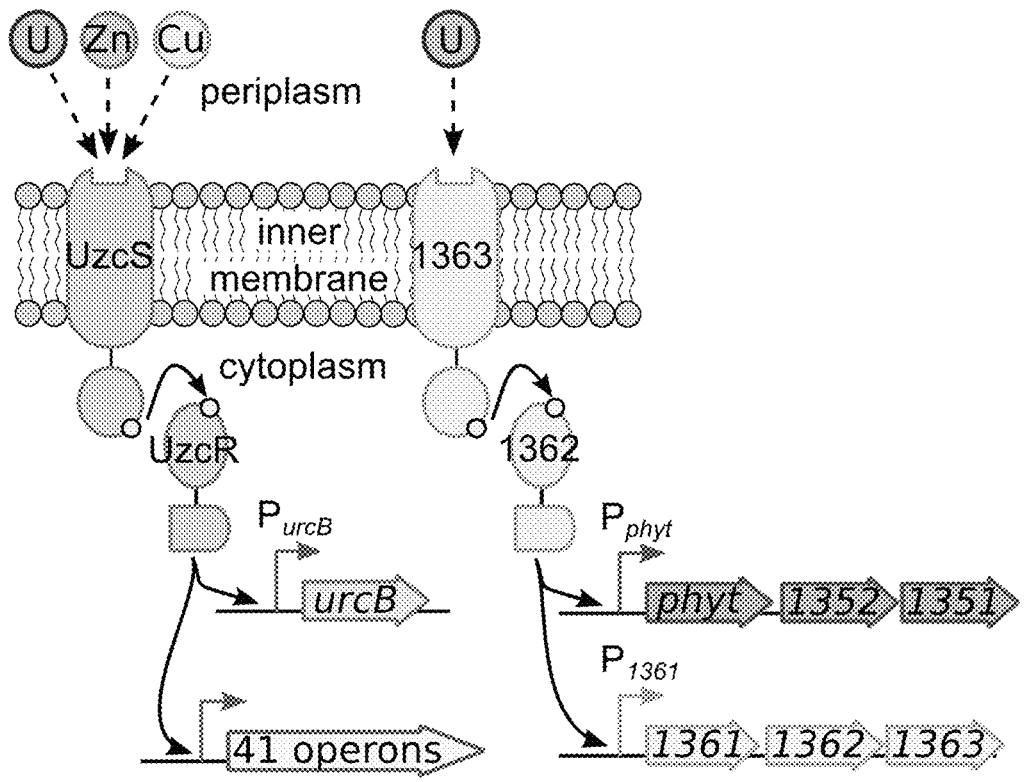
FIG. 3A shows schematics of two exemplary independent two component systems (TCS) that are sensitive to U in Caulobacter crescentus. Shown on the left side of FIG. 3A is a schematic of the putative mechanism of action of the UzcRS TCS, which was characterized as a transcriptional activator of at least 40 operons in response to U/Zn/Cu [3]. Shown on the right side of FIG. 3A is a schematic of the putative mechanism of action of the 1363/1362 TCS, wherein a histidine kinase 1363 (encoded by CCNA_01363) and a response regulator 1362 (encoded by CCNA_01362) activate promoters comprising the 1362 regulator direct repeat DNA binding site, e.g. $P_{phyt}$ and $P_{1361}$, in response to U. 1363 is membrane-bound and senses U either through a direct (U binding to 1363) or indirect mechanism. Upon U sensing, it is expected that 1363 autophosphorylates and then transphosphorylates 1362, activating 1362 for DNA binding of the 1362 direct repeat, e.g. in $P_{phyt}$ or $P_{1361}$. Possible additional stimuli for 1363/1362 remain unknown (indicated by the circled question mark).

An exemplary illustration of two-component system formed by the U-sensitive histidine kinase 1363 (UrpS) and the cognate response regulator 1362 (UrpR) is shown in the schematics of FIG. 3A.

Genes encoding histidine kinase 1363 (UrpS) and response regulator 1362 (UrpR) herein described are herein also indicated as 1363 gene or 1363 and 1362 gene or 1362, respectively as will be understood by a skilled person.

A representative example of histidine kinase P1363 (UrpS) and response regulator 1362 (UrpR) in a two component system herein described are provided by the histidine kinase encoded by 1363 gene CCNA_01363 in *Caulobacter crescentus* (SEQ ID NO:3), and the response regulator 1362 encoded by 1362 gene CCNA_01362 (SEQ ID NO:4), forming a two component systems respectively as will be understood by a skilled person.

In some embodiments the histidine kinase P1363 (UrpS) and response regulator p1362 (UrpR) can be heterologously expressed in the bacterial cell through genetic engineering of the cell performed to include in the cell a U-sensing regulator genetic molecular component comprising an endogenous or exogenous gene encoding histidine kinase 1363 (UrpS) and an endogenous or exogenous gene encoding U-sensitive transcriptional regulator 1362 (UrpR) in a configuration wherein the gene encoding histidine kinase 1363 and the gene encoding response regulator 1362 (UrpR) response regulator UzcR are expressed upon activation of a controllable promoter.

In some embodiments the histidine kinase P1363 (UrpS) and response regulator p1362 (UrpR) can be natively expressed in the bacterial cell. In particular in some embodiments, the host cell of the U-biosensors herein described is capable of natively expressing the proteins of the U-sensing two-component system 1363 (UrpS) and 1362 (UrpR) described herein. Those embodiments typically comprise certain proteobacterial cell such as alphaproteobacteria, betaproteobacteria or gammaproteobacteria comprising an endogenous 1363/1362 TCS (UrpRS) which can be identified and selected by methods to detect 1363 (UrpS) and/or 1362 (UrpR) genes in a candidate bacterial cell identifiable by a skilled person.

For example, presence of a 1363/1362 TCS or UrpRS in a proteobacterial cell can be identified by wet bench experiments, such as PCR, Southern blotting and additional techniques identifiable by a skilled person performed with histidine kinase P1363 (UrpS) and response regulator p1362 (UrpR) and/or fragments thereof used as primers or probes for the related detection, followed by isolation and sequencing of the identified 1363 gene and/or 1362 gene as will be understood by a skilled person.

In addition or in the alternative, presence of a 1363/1362 TCS (UrpRS) in a proteobacterial cell can be identified by performing a sequence alignment using BLASTP or PSI-BLAST or other alignment algorithms known to persons skilled in the art with the 1363 (UrpS) amino acid sequence of *C. crescentus* NA1000 (SEQ ID NO:3) and/or the 1362 (UrpR) protein sequence of *Caulobacter crescentus* NA1000 (SEQ ID NO:4) as a query sequence against protein sequences of a given proteobacterial cell, as would be understood by a skilled person.

In some embodiments, the U sensing bacterial cell can comprise proteobacteria capable of natively expressing a 1363 (UrpS) protein having 100% homology to 1363 (UrpS) protein of *C. crescentus* NA1000 (SEQ ID NO: 3), and/or having a BLAST Score of 851 when aligned with SEQ ID NO: 3, (herein also 1363/1362 Tier 1 proteobacteria or UrpRS Tier 1 proteobacteria) such as proteobacteria *C. crescentus* NA1000 and *C. crescentus* CB15.

In some embodiments, the U sensing bacterial cell can comprise proteobacteria capable of natively expressing 1363 (UrpS) proteins having a BLAST Score over 800 when aligned to 1363 (UrpS) protein of *C. crescentus* NA1000 (SEQ ID NO: 3) and with less than 100% homology to *C. crescentus* NA1000 1363) SEQ ID NO: 3, (herein also 1363/1362 Tier 2 proteobacteria or UrpRS Tier 2 proteobacteria) such as exemplary proteobacterium *C. crescentus* CB2 among others identifiable by persons skilled in the art.

In some embodiments, the U sensing bacterial cell can comprise proteobacteria capable of natively expressing 1363 (UrpS) proteins having a BLAST Score of 500-800 when aligned to 1363 (UrpS) protein of *C. crescentus* NA1000 (SEQ ID NO: 3) (herein also 1363/1362 Tier 3 or UrpRS Tier 3) such as proteobacteria *Caulobacter henricii, Caulobacter* sp. CCH5-E12, *Caulobacter* sp. OV484, *Caulobacter* sp. Root487D2Y, *Caulobacter* sp. Root1455, *Caulobacter* sp. 12-67-6, *Caulobacter* sp. Root487D2Y, *Caulobacter* sp. Root1455, *Caulobacter* sp. UNC358MFTsu5.1, *Caulobacter* sp. AP07 and *Caulobacter*, among others identifiable by persons skilled in the art.

In some embodiments, the U sensing bacterial cell can comprise proteobacteria capable of natively comprising a 1362 (UrpR) binding site (SEQ ID NO: 1) in a phytase or 1361 promoter, also referred to herein as "Pphyt" and "P1361", respectively (herein also indicated as 1363/1362 Tier 4 proteobacteria or UrpRS Tier 4 proteobacteria). Exemplary proteobacteria within these embodiments comprise *Caulobacter* sp. Root342, *Phenylobacterium* sp. Root700, *Caulobacter crescentus* NA1000, *Caulobacter* sp. Root1455, *Caulobacter* sp. Root487D2Y, *Paracoccus* sp. 228, Caulobacteraceae bacterium OTSz_A_272, *Novosphingobium* sp. AP12 PMI02, *Hyphomicrobium* sp. MCi, *Hyphomicrobium denitrificans*, *Brevundimonas* sp. Root1279 *Sphingopyxis* sp. Root1497, *Afipia* sp. P52-10, *Caulobacter* sp. Root342 *Hyphomicrobium denitrificans*, *Sphingobium* sp. YBL2, *Sphingobium baderi* LL03, *Sphingobium indicum* B90A, and *Roseovarius indicus* strain DSM 26383, among others identifiable by persons skilled in the art.

In some embodiments, the U sensing bacterial cell can comprise proteobacteria capable of natively expressing 1363 (UrpS) proteins having a BLAST Score of 300-500 when aligned to 1363 protein of *C. crescentus* NA1000 (SEQ ID NO: 3) (herein also indicated as 1363/1362 Tier 5 proteobacteria or UrpRS Tier 5 proteobacteria) such as exemplary proteobacteria *Phenylobacterium* sp. Root700, *Phenylobacterium* sp. Root700, *Caulobacter* sp. 39-67-4, *Sphingopyxis* sp. SCN 67-31, *Phenylobacterium* sp. SCN 70-31, *Sphingopyxis flava*, Caulobacteraceae bacterium OTSz_A_272, *Sphingobium baderi*, Caulobacterales bacterium 68-7, alpha proteobacterium U9-1i, *Caulobacter* sp. 35-67-4, *Sphingopyxis granuli*, *Sphingopyxis macrogoltabida*, *Brevundimonas* sp. Root1279, *Sphingopyxis macrogoltabida*, *Brevundimonas* sp. Root1279, *Sphingopyxis macrogoltabida*, *Hyphomonas polymorpha*, *Porphyrobacter mercurialis*, Caulobacteraceae bacterium TH1-2, Hyphomonadaceae bacterium UKL13-1, *Sphingopyxis macrogoltabida*, *Porphyrobacter mercurialis*, and *Novosphingobium* sp. PASSN1, among others identifiable by persons skilled in the art.

In some embodiments, the U sensing bacterial cell can comprise proteobacteria capable of natively expressing 1363 (UrpS) proteins having a BLAST Score of 240-300 when aligned to 1363 protein of *C. crescentus* NA1000 (SEQ ID NO3), (herein indicated also as 1363/1362 Tier 6 proteobacteria or UrpRS Tier 6 proteobacteria) identifiable by persons skilled in the art.

In some embodiments, the U sensing bacterial cell can comprise proteobacteria capable of natively expressing 1363 proteins having a BLAST Score of 200-240 when aligned to 1363 protein of *C. crescentus* NA1000 (SEQ ID NO:3) (herein also indicated as 1363/1362 Tier 7 proteobacteria or UrpRS Tier 7 proteobacteria), identifiable by persons skilled in the art.

In some embodiments, the U sensing bacterial cell can comprise proteobacteria capable of natively expressing 1363 (UrpS) proteins having a BLAST Score of less than 200 when aligned to 1363 (UrpS) protein of *C. crescentus* NA1000 (SEQ ID NO: 3) (herein also indicated as 1363/1362 Tier 8 proteobacteria or UrpRS Tier 8 proteobacteria), identifiable by persons skilled in the art (herein also indicated as Tier 8 proteobacteria).

In embodiments of the U biosensor herein described wherein the host cell is a proteobacterial cell of any one of 1363/1362 Tiers 1 to 6 (UrpRS Tiers 1 to 6), the host proteobacterium can comprise a bacterial cell with a natively and/or heterologously expressed 1363/1362 TCS (UrpRS) endogenous to the host proteobacterium. In embodiments wherein the host cell is a bacterial cell other than proteobacteria or a proteobacteria of 1363/1362 Tiers 7 and 8, the host is engineered to include a heterologous 1363/1362 TCS system in a configuration capable of heterologous expression in the host bacteria as will be understood by a skilled person. In some embodiments wherein the host cell is a proteobacteria of 1363/1362 Tier 6, the host can be firstly tested for the presence of a natively expressed 1363/1362 TCS endogenous to the host proteobacteria according to procedure identifiable by a skilled person. The test can be performed by transforming the cell with a plasmid or other vector containing Pphyt or P1361-regulated gfp fusion and assaying the system for U-dependent induction of GFP as will be understood by a skilled person. If the host cell does not possess a natively expressed 1363/1362 TCS, the host can be engineered to include a heterologous 1363/1362 TCS system in a configuration capable of heterologous expression in the host bacteria.

In embodiments wherein a heterologous 1363/1362 TCS (UrpRS) is introduced into the host cell, the heterologous 1363/1362 TCS can be a 1363/1362 TCS system from a 1363/1362 Tier 1, a 1363/1362 Tier 2, a 1363/1362 Tier 3, a 1363/1362 Tier 4 or a 1363/1362 Tier 5 proteobacteria, and it is preferably a 1363/1362 TCS from a 1363/1362 Tier 2 proteobacteria and more preferably from a 1363/1362 Tier 1 proteobacteria. In those embodiments wherein a heterologous 1363/1362 TCS is introduced into a host cell, the native 1363/1362 TCS of the host cell is preferably knocked out, in particular in embodiments wherein the host organism is a proteobacteria of any one of 1363/1362 Tiers 1 to 6. The native 1363/1362 TCS of the host cell can be knocked out by deleting or inactivating the 1362 gene cluster only or by deleting or otherwise inactivating both the 1362 and 1363 gene clusters.

In some embodiments, $UO_2F_2$-biosensors herein described the proteobacterial cell is capable of natively and/or heterologously expressing a U-sensitive histidine kinase UzcS, and a transcriptional response regulator UzcR.

The term "histidine kinase UzcS", "UzcS" in the sense of the disclosure refers to a histidine kinase having the amino acid sequence:

(SEQ ID NO: 5)
MRLPRLLRTTPFRLTLLFLALFAAAASAFLGYIYVATAGEVNRRAQA

EISREFESLEAAYRQGGVDALNQTIVERATSERPFLYFLADKDGKRI

SGSIEESPVSGFTGDGPEWASFKVTETDLDGAEVKAAARGVQQRLDN

GEILFVGADVDASEAYVRKIVRALWGAGALVILLGMAGGVLISRNVS

RSMQGLVDVVNAVRGGDLHARARVRGTRDEYDELAEGLNDMLDRIER

LMGGLRHAGDAIAHDLRSPLTRLRARMEVALIDAENGKGDPVAALET

ALQDADGVLKTFNAVLAIARLQAAGSAPDQRQFDASELAGDMAELYE

LSCEDKGLDFKAEIVPALTIKGNREFLAQALANILDNAIKYTPEGGA

IMLRARRTSSGELEFSVTDTGPGVPEADRARVVQRFVRLENSRSEPG

AGLGLSLVSAVATSHGGRLELAEGPGEYNGMGPGLRVALVLPRVE.

or a sequence that when aligned with sequence SEQ ID NO: 5 has a BLAST score has a BLAST score greater than 300 and less than 500, or preferably greater than 500 and less than 767, or more preferably a BLAST score greater than 800 and a homology with SEQ ID NO: 5 less than 100%, or even more preferably BLAST score of 925 and an homology of 100% with SEQ ID NO: 5.

The term "transcriptional response regulator UzcR" or "UzcR' as used herein indicates a transcriptional regulator having the amino acid sequence:

(SEQ ID NO: 6)
MRILIIEDDLEAAGAMAHGLKEAGYDVAHAPDGEAGLAEAQKGGWDV

LVVDRMMPKMDGVTVVETLRREGDQTPVLFLSALGEVNDRVVGLKAG

ADDYLVKPYAFPELMARVEALSRRRETGAVATTLKVGELEMNLINRT

VHRQGKEIDLQPREFQLLEFMMRHAGQSVTRTMLLEKVWEYHFDPQT

NVIDVHISRLRSKIDKGFDRAM LQTVRGAGYRLDP.

or a sequence that when aligned with sequence SEQ ID NO: 6 has a BLAST score greater than 250 and less than 300, or preferably greater than 300 and less than 400, or more preferably a BLAST score greater than 400 and a homology with SEQ ID NO: 6 less than 100%, or even more preferably a BLAST score of 452 and an homology of 100% with SEQ ID NO: 6.

Figure 3B:
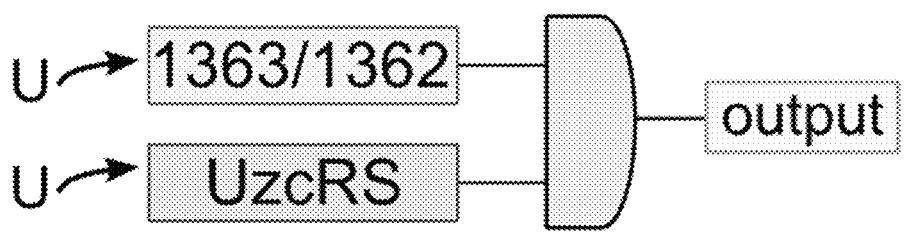
FIG. 3B shows a schematic of an exemplary U-sensitive AND gate that incorporates two independent points of uranyl sensing inputs (the two-component systems 1363/1362 AND UzcRS), which are both required to affect an output (such as a reportable molecular component and/or a U-neutralizing molecular component). The 1363/1362 two-component system is specifically activated by uranyl. The UzcRS two component system is activated for transcriptional regulation by uranyl, as well as zinc, copper and cadmium [3].

In $UO_2F_2$-biosensors herein described, the U-sensitive histidine kinase UzcS, and transcriptional response regulator UzcR form a two-component system in the sense of the disclosure, also referred to herein as "UzcRS two-component system" or "UzcRS TCS" which is similar to the 1363/1362 TCS system herein described and exemplified by the schematics of FIG. 3.

In particular, the term "UzcRS two component system" or "UzcRS TCS" as used herein refers to a regulatory system responsible for U, Zn, and Cu-dependent regulation of numerous genes in *Caulobacter crescentus* [3]. The UzcRS two component system comprises an OmpR/PhoB family response regulator (RR) and a histidine kinase (HK) containing a 123 amino acid periplasmic domain, placing it in the periplasmic-sensing class of histidine kinases [42].

Genes encoding histidine kinase UzcS and response regulator UczR herein described are herein also indicated as UzcS gene or UzcS and UczR gene or UczR, respectively as will be understood by a skilled person.

A representative example of histidine kinase UzcS and transcriptional response regulator UzcR in a UzcRS two components system herein described are provided by histidine kinase encoded by UzcS gene CCNA_02842 in *C. crescentus* NA1000 (SEQ ID NO: 5) and by a transcriptional response regulator, for example encoded by UzcR gene CCNZ_02485 in *C. crescentus* NA1000 (SEQ ID NO: 6) as will be understood by a skilled person.

In some embodiments the histidine kinase UzcS and transcriptional response regulator UzcR can be heterologously expressed in the bacterial cell through genetic engineering of the cell performed to include in the cell a U-sensing regulator genetic molecular component comprising an endogenous or exogenous gene encoding histidine kinase UzcS and an endogenous or exogenous gene encoding U-sensitive transcriptional response regulator UzcR in a configuration wherein the gene encoding histidine kinase UzcS and the gene encoding response regulator UzcR are expressed upon activation of a controllable promoter.

In some embodiments the histidine kinase UzcS and transcriptional response regulator UzcR are natively expressed in the bacterial cell. In particular in some embodiments, the host cell of the U-biosensors herein described is capable of natively expressing the proteins of the U-sensing UzcS/UzcR TCS described herein. Those embodiments typically comprise certain proteobacterial cell such as alphaproteobacteria, betaproteobacteria or gammaproteobacteria comprising an endogenous UzcS/UzcR TCS which can be identified and selected by methods to detect UzcS and/or UzcR genes in a candidate bacterial cell identifiable by a skilled person.

For example, presence of a UzcS/UzcR TCS in a proteobacterial cell can be identified by wet bench experiments, such as PCR, Southern blotting and additional techniques identifiable by a skilled person performed with histidine kinase UzcS and response regulator UzcR and/or fragments thereof used as primers or probes for the related detection, followed by isolation and sequencing of the identified UzcS gene and/or UzcR gene as will be understood by a skilled person. The presence of an UzcS/UzcR TCS can also be identified by introducing in the cell a UzcR-regulated GFP fusion promoter and detecting GFP fluorescence thus testing for U-dependent fluorescence as will be understood by a skilled person.

In addition or in the alternative, a UzcS/UzcR TCS in a proteobacterial cell can be identified by performing a sequence alignment using BLASTP or PSI-BLAST or other alignment algorithms known to persons skilled in the art with the UzcS amino acid sequence of *C. crescentus* NA1000 (SEQ ID NO: 5) and/or the UzcR protein sequence of *Caulobacter crescentus* NA1000 (SEQ ID NO: 6) as a query sequence against protein sequences of a given proteobacterial cell, as would be understood by a skilled person.

In some embodiments, the U sensing bacterial cell can comprise proteobacteria capable of natively expressing UzcS proteins having 100% homology to UzcS protein of *C. crescentus* NA1000 (SEQ ID NO: 5) and a BLAST score of 925 when aligned to sequence SEQ ID NO: 5 (herein also indicated as UzcS/UzcR Tier 1 proteobacteria).

In some embodiments, the U sensing bacterial cell can comprise proteobacteria capable of natively expressing UzcS proteins having a homology of less than 100% to UzcS protein of *C. crescentus* NA1000 (SEQ ID NO: 5) and a BLAST score greater than 800 when aligned to sequence SEQ ID NO: 5 (herein also indicated as UzcRS Tier 2 proteobacteria).

In some embodiments, the U sensing bacterial cell can comprise proteobacteria capable of natively expressing UzcS proteins a BLAST score greater than 767 and lower than 800 when aligned to sequence SEQ ID NO: 5 (herein also indicated as UzcRS Tier 3 proteobacteria).

In some embodiments, the U sensing bacterial cell can comprise proteobacteria capable of natively expressing UzcS proteins having a BLAST score greater than 500 and less than 767 when aligned to sequence SEQ ID NO: 5 (herein also indicated as UzcRS Tier 4 proteobacteria).

In some embodiments, the U sensing bacterial cell can comprise proteobacteria capable of natively expressing UzcS proteins having a BLAST score greater than 300 and less than 500 when aligned to sequence SEQ ID NO: 5 (herein also indicated as UzcRS Tier 5 proteobacteria).

In some embodiments, the U sensing bacterial cell can comprise proteobacteria capable of natively expressing UzcS proteins having a BLAST score greater than 250 and less than 300 when aligned to sequence SEQ ID NO: 5 (herein also indicated as UzcRS Tier 6 proteobacteria).

In some embodiments, the U sensing bacterial cell can comprise proteobacteria capable of natively expressing UzcS proteins having a BLAST score greater than 200 and less than 250 when aligned to sequence SEQ ID NO: 5 (herein also indicated as UzcRS Tier 7 proteobacteria).

In some embodiments, the U sensing bacterial cell can comprise proteobacteria capable of natively expressing UzcS proteins having a BLAST score less than 200 when aligned to sequence SEQ ID NO: 5 (herein also indicated as UzcRS Tier 8 proteobacteria).

In embodiments of the U biosensor herein described wherein the host cell is a proteobacterial cell of any one of UzcRS Tiers 1 to 6, the host proteobacterium can comprise a bacterial cell with a natively and/or heterologously expressed UzcRS TCS endogenous to the host proteobacterium. In embodiments wherein the host cell is a bacterial cell other than proteobacteria or a proteobacteria of UzcRS Tiers 7 and 8, the host is engineered to include a heterologous UzcRS TCS system in a configuration capable of heterologous expression in the host bacteria as will be understood by a skilled person.

In embodiments wherein a heterologous UzcRS TCS is introduced into the host cell, the heterologous UzcRS TCS can be a UzcRS TCS system from a 1363/1362 Tier 1, a UzcRS Tier 2, a UzcRS Tier 3, a UzcRS Tier 4 or a UzcRS Tier 5 proteobacteria, and it is preferably a UzcRS TCS from a UzcRS Tier 2 proteobacteria and more preferably UzcRS TCS from a UzcRS Tier 1 proteobacteria. In those embodiments wherein a heterologous UzcRS TCS is introduced into a host cell, the native UzcRS TCS of the host cell is preferably knocked out, in particular in embodiments wherein the host organism is a proteobacteria of any one of UzcRS Tiers 1 to 6. The native UzcRS TCS of the host cell can be knocked out by deleting or otherwise inactivating the UzcR gene cluster only or by deleting or otherwise inactivating both the UzcR and UzcS gene clusters according to techniques identifiable by a skilled person (e.g. by microdeletion, clean deletion via double recombination, recombineering (e.g., Wanner method [46]) insertional inactivation, CRISPRi, CRISPR-mediate recombination, transposon insertion, mutational inactivation, methylation and/or epigenetic inactivation as well as other techniques identifiable by a skilled person).

In some embodiments of the $UO_2F_2$-biosensors herein described, a bacterial cell capable of natively and/or heterologously expressing histidine kinase 1363, and transcriptional response regulator 1362, and/or capable of natively and/or heterologously expressing a U-sensitive histidine kinase UzcS, and a transcriptional response regulator UzcR, is genetically engineered to include a U-sensitive genetic molecular component configured to report and/or neutralize U.

The term "molecular component" as used herein indicates a chemical compound comprised in a cellular environment. Exemplary molecular components thus comprise polynucleotides, such as ribonucleic acids or deoxyribonucleic acids, polypeptides, polysaccharides, lipids, amino acids, peptides, sugars and/or other small or large molecules and/or polymers that can be found in a cellular environment.

The term "genetic molecular component" as used herein indicates a molecular unit formed by a gene, an RNA transcribed from the gene or a portion thereof and optionally a polypeptide or a protein translated from the transcribed RNA.

In embodiments herein described, a genetic molecular component comprises a promoter operatively connected to the gene of the genetic molecular component, so that the promoter is configured to initiate transcription of said gene. As would be understood by those skilled in the art, promoters are typically located adjacent to the transcription start sites of genes, on the same strand and upstream on a DNA sequence (towards the 5' region of the sense strand), and for transcription to occur, the enzyme that synthesizes RNA, known as RNA polymerase, attaches to the promoter. Promoters contain DNA sequences identifiable by those skilled in the art and described herein, such as those that provide binding sites for RNA polymerase and also for proteins that function as transcription regulatory factors that can either activate or repress gene transcription.

The term "transcription regulatory factor" or "transcription factor" as used herein refers to any type of factors that can function by acting on a regulatory DNA element such as a promoter or enhancer sequence. The transcription regulatory factors can be broadly classified into a transcription repression factor (also referred to as "repressor") and a transcription activation factor (also referred to as "activator"). The transcription repression factor acts on a regulatory DNA element to repress the transcription of a gene, thereby reducing the expression level of the gene. The transcription activation factor acts on a regulatory DNA element to promote the transcription of a gene, thereby increasing the expression level of the gene. Both the transcription repression factors and the transcription activation factors can be used as one or more components in the gene circuits herein described. In particular, a transcription regulatory factor has typically at least one DNA-binding domain that can bind to a specific sequence of enhancer or promoter sequences. Some transcription factors bind to a DNA promoter sequence near the transcription start site and help form the transcription initiation complex. Other transcription factors bind to other regulatory sequences, such as enhancer sequences, and can either stimulate or repress transcription of the related gene. Examples of specific transcription repression factors include TetR, LacI, LambdaCI, PhlF, SrpR, QacI, BetR, LmrA, AmeR, LitR, met, and others identifiable by a skilled person, as well as homologues of known repression factors, that function in both prokaryotic and eukaryotic systems. Examples of transcription activation factors include AraC, LasR, LuxR, IpgC, MxiE, Gal4, GCN4, GR, SP1, CREB, and additional activation factors identifiably by a skilled person as well as homologues of known activation factors that function in both prokarayotic and eukaryotic systems also identifiable by a skilled person. Exemplary inducible regulators that can be used in *Caulobacter* comprise VanR (regulated by vanillate) and XylR (regulated by xylose), as well as others identifiable by those skilled in the art.

A gene comprised in a genetic molecular component is a polynucleotide that can be transcribed to provide an RNA and typically comprises coding regions as well as one or more regulatory sequence regions which is a segment of a nucleic acid molecule which is capable of increasing or decreasing transcription or translation of the gene within an organism either in vitro or in vivo. In particular coding regions of a gene herein described can comprise one or more protein coding regions which when transcribed and translated produce a polypeptide, or if RNA is the final product only a functional RNA sequence that is not meant to be translated. Regulatory regions of a gene herein described comprise promoters, transcription factor binding sites, operators, activator binding sites, repressor binding sites, enhancers, protein-protein binding domains, RNA binding domains, DNA binding domains, silencers, insulators and additional regulatory regions that can alter gene expression in response to stimuli as will be recognized by a person skilled in the art.

An RNA of a genetic molecular component comprises any RNA that can be transcribed from a gene, such as a messenger ribonucleic acid (mRNA), short interfering ribonucleic acid, and ribonucleic acid capable of acting as regulating factors in the cell. mRNA comprised in a genetic molecular component comprise regions coding for the protein as well as regulatory regions e.g. ribosome binding site domains ("RBS"), which is a segment of the upstream (5') part of an mRNA molecule to which the ribosomal machinery of a cell binds to position the message correctly for the initiation of translation. RBSs control the accuracy and efficiency with which the translation of mRNA begins. mRNA can have additional control elements encoded, such as riboregulator sequences or other sequences that form hairpins, thereby blocking the access of the ribosome to the Shine-Delgarno sequence and requiring an external source, such as an activating RNA, to obtain access to the Shine-Delgarno sequence. Other RNAs that serve regulatory roles that can comprise the genetic molecular component include riboswitches, aptamers (e.g. malachite green, Spinach), aptazymes, guide CRISPR RNAs, and other RNAs known to those skilled in the art.

A protein comprised in a molecular component can be proteins with activating, inhibiting, binding, converting, or reporting functions. Proteins that have activating or inhibiting functions typically act on operator sites encoded on DNA, but can also act on other molecular components. Proteins that have binding functions typically act on other proteins, but can also act on other molecular components. Proteins that have converting functions typically act on small molecules, and convert small molecules from one small molecule to another by conducting a chemical or enzymatic reaction. Proteins with converting functions can also act on other molecular components. Proteins with reporting functions have the ability to be easily detectable by commonly used detection methods (absorbance, fluorescence, for example), or otherwise cause a reaction on another molecular component that causes easy detection by a secondary assay (e.g. adjusts the level of a metabolite that can then be assayed for). The activating, inhibiting binding, converting, or reporting functions of a protein typically form the interactions between genetic components of a genetic circuit. Exemplary proteins that can be comprised in a genetic molecular component comprise monomeric proteins and multimeric proteins, proteins with tertiary or quaternary structure, proteins with linkers, proteins with non-natural amino acids, proteins with different binding domains, and other proteins known to those skilled in the art. Specific exemplary proteins include TetR, LacI, LambdaCI, PhlF, SrpR, QacI, BetR, LmrA, AmeR, LitR, met, AraC, LasR, LuxR, IpgC, MxiE, Gal4, GCN4, GR, SP1, CREB, and others known to a skilled person in the art.

A "U-sensing genetic molecular component" or "U-sensitive genetic molecular component" as used herein indicates a genetic molecular component wherein the gene of the genetic molecular component is under control of a U-sensing or U-sensitive promoter.

In particular, in some embodiments herein described, wherein the host cell is capable of natively and/or heterologously expressing the histidine kinase P1363 and response regulator p1362, at least one U-sensitive promoter comprises a U-sensitive 1362 binding site having a DNA sequence (SEQ ID NO: 1)
$N_1N_2N_3N_4N_5N_6N_7N_8N_9N_{10}N_{11}N_{12}N_{13}N_{14}N_{15}N_{16}N_{17}N_{18}$, wherein
$N_1$ is C or T, preferably C;
$N_2$ is G or A, preferably G;
$N_3$ is T or C, preferably T;
$N_4$ is C; $N_5$ is A or G, preferably A;
$N_6$ is G or C, preferably G;
$N_7$ C or G;
$N_8$ is any nucleotide;
$N_9$ is any nucleotide;
$N_{10}$ is any nucleotide;
$N_{11}$ is any nucleotide;
$N_{12}$ is T or C;
$N_{13}$ is G;
$N_{14}$ is T or C, preferably T;
$N_{15}$ is C;
$N_{16}$ is A or C, preferably A;
$N_{17}$ is G; and
$N_{18}$ is C or G
and wherein $N_1$ to $N_{17}$ are selected independently.

In some embodiments of the U-sensing promoter comprising SEQ ID NO: 1, nucleotide $N_1$ of the regulator direct repeat is in a position from about 16 nucleotides downstream of the transcription start site of the genetic molecular component as described herein to about 40 nucleotides upstream of the transcription start site of the genetic molecular component or genetic molecular component.

In some embodiments, the U-sensitive promoter further comprises nucleotides $N_{19}N_{20}N_{21}$ (SEQ ID NO: 83), downstream of SEQ ID NO: 1 wherein each of $N_{19}$ to $N_{21}$ can independently be any nucleotide, and therefore $N_{19}$ is any nucleotide $N_{20}$ is any nucleotide; and $N_{21}$ is G.

In some embodiments of the U biosensors described herein, the 1362 binding site has a DNA sequence CGTCAGCNNNNTGTCAGC (SEQ ID NO:7), CGTCAGGNNNNTGTCAGG (SEQ ID NO: 8), CGTCAGCNNNNTGTCAGG (SEQ ID NO:9), CGTCAGCNNNNCGTCAGG (SEQ ID NO: 10), TGTCAGCNNNNTGTCAGC (SEQ ID NO: 11), CGCCTGCNNNNCGTCAGC (SEQ ID NO: 12), CGTCAGGNNNNCGTCAGC (SEQ ID NO: 13), CGTCAGCNNNNTGTCAGC (SEQ ID NO: 14), TGTCAGGNNNNTGTCAGC (SEQ ID NO: 15), CGTCAGCNNNNCGTCAGT (SEQ ID NO: 16), CCGCGGGNNNNTGTCAGG (SEQ ID NO: 17), CGTCGGGNNNNAGACCGG (SEQ ID NO: 18), CGTCCGGNNNNCGTCAGA (SEQ ID NO: 19), CAACGCCNNNNCGTCAGC (SEQ ID NO: 20), CATCAGGNNNNCGTCAGC (SEQ ID NO: 21), CGCAGGGNNNNTGCAAGC (SEQ ID NO: 22), CATCAGCNNNNCGTCAGC (SEQ ID NO: 23), CGTCATCNNNNTGTCACG (SEQ ID NO: 24), CGTCAGCNNNNCATCAGC (SEQ ID NO: 25), CTTCGCGNNNNCGTCCGG (SEQ ID NO: 26), CGTCAGGNNNNGGTCAGG (SEQ ID NO: 27), or TGTCAGCNNNNATCCTGC (SEQ ID NO: 28), wherein N can be any nucleotide.

In some embodiments, wherein the U-biosensor comprises a genetically engineered proteobacterial cell capable of natively and/or heterologously expressing histidine kinase UzcS, and U-sensitive transcriptional response regulator UzcR, at least one U-sensitive promoter comprises a UzcR binding site with an m_5 site configured for binding UzcR, having a DNA sequence:

(SEQ ID NO: 2)
CATTACN$_7$N$_8$N$_9$N$_{10}$N$_{11}$N$_{12}$TTAA wherein $N_7$-$N_{12}$ is independently any nucleotide, and in some embodiments $N_7$-$N_{11}$ can independently be A. In an embodiment, each of $N_7$-$N_{12}$ can be A.

In some embodiments, in the proteobacterial cell, the endogenous genes encoding the histidine kinase UzcS and the U-sensitive transcriptional response regulator UzcR, are knocked out and the genetically engineered proteobacterial cell is further engineered to include a U-sensing regulator genetic molecular component comprising an endogenous or exogenous gene encoding histidine kinase UzcS, and an endogenous or exogenous gene encoding U-sensitive transcriptional response regulator UzcR in a configuration wherein the a gene encoding histidine kinase UzcS, and a gene encoding response regulator UzcR are expressed upon activation of a controllable promoter.

In some embodiments, the U-sensitive promoter comprises a UzcR binding site can be either a constitutively active promoter or an inducible promoter. In preferred embodiments, the promoter is constitutively active.

The term "m_5 site" or "UzcR binding site" as used herein refers to a semi-palindromic consensus DNA binding site of sequence $CATTACN_7N_8N_9N_{10}N_{11}N_{12}TTAA$ (SEQ ID NO:2) [3], wherein $N_7$-$N_{12}$ is independently any nucleotide, and in some embodiments any one of $N_7$-$N_{11}$ can independently be A. One UzcR dimer likely to binds one m_5 site [3]. For example, a variant of an m_5 site wherein CATTAC (SEQ ID NO:29) is mutated to CAATAG (SEQ ID NO:30) is not bound by UzcR and a variant of an m_5 site wherein TTAA (SEQ ID NO:31) is mutated to TAAT (SEQ ID NO:32) is no longer activated by UzcR [3].

In embodiments herein described, UzcRS-regulated promoters comprise those having naturally-occurring m_5 sites or m_5 sites that are introduced into a promoter through genetic engineering. Accordingly, UzcRS-regulated promoters comprise DNA sequence elements required for RNA Polymerase binding, as well as one or more m_5 sites, such that the promoter is configured to be regulated by the UzcRS two-component system. Similar to promoters comprising 1362 binding sites, in UzcRS-regulated promoters, the σ-RNAP biding sites typically have low sequence homology to the canonical $σ^{73}$-RNAP −10 and −35 hexamer sequences. Accordingly, typically transcriptional activation of native UzcRS-regulated promoters occurs through binding of UzcR to the promoter, consistent with little observed transcriptional activation in absence of UzcR.

In some embodiments, an UzcRS-regulated promoter can comprise 1-3 copies of the m_5 site. In particular, in some embodiments, when one or more m_5 sites are located at a position from about −50 to about −100 upstream of the TSS, preferably at a position −52/53 or −62/63 upstream of the TSS, considering the first nucleotide of Seq ID NO: 2 as the first nucleotide of the m_5 site upstream from the TSS (see the position of the first nucleotide (C on the 5' end) of the binding site in FIG. 25 A) wherein the m_5 site is configured for activation of the UzcRS-regulated promoter (see e.g. configurations of FIG. 25B); [3]). In some embodiments, one or more m_5 sites are located at a position 52 to 53 bp upstream of the TSS or at a position 62 or −63 bp upstream of the TSS considering the first nucleotide of Seq ID NO: 2 as the first nucleotide of the m_5 site upstream from the TSS (see the position of the first nucleotide (C on the 5' end) of the binding site in FIG. 25 A) wherein the m_5 site is configured for activation of the UzcRS-regulated promoter (see e.g. FIG. 25 B).

Figure 25:
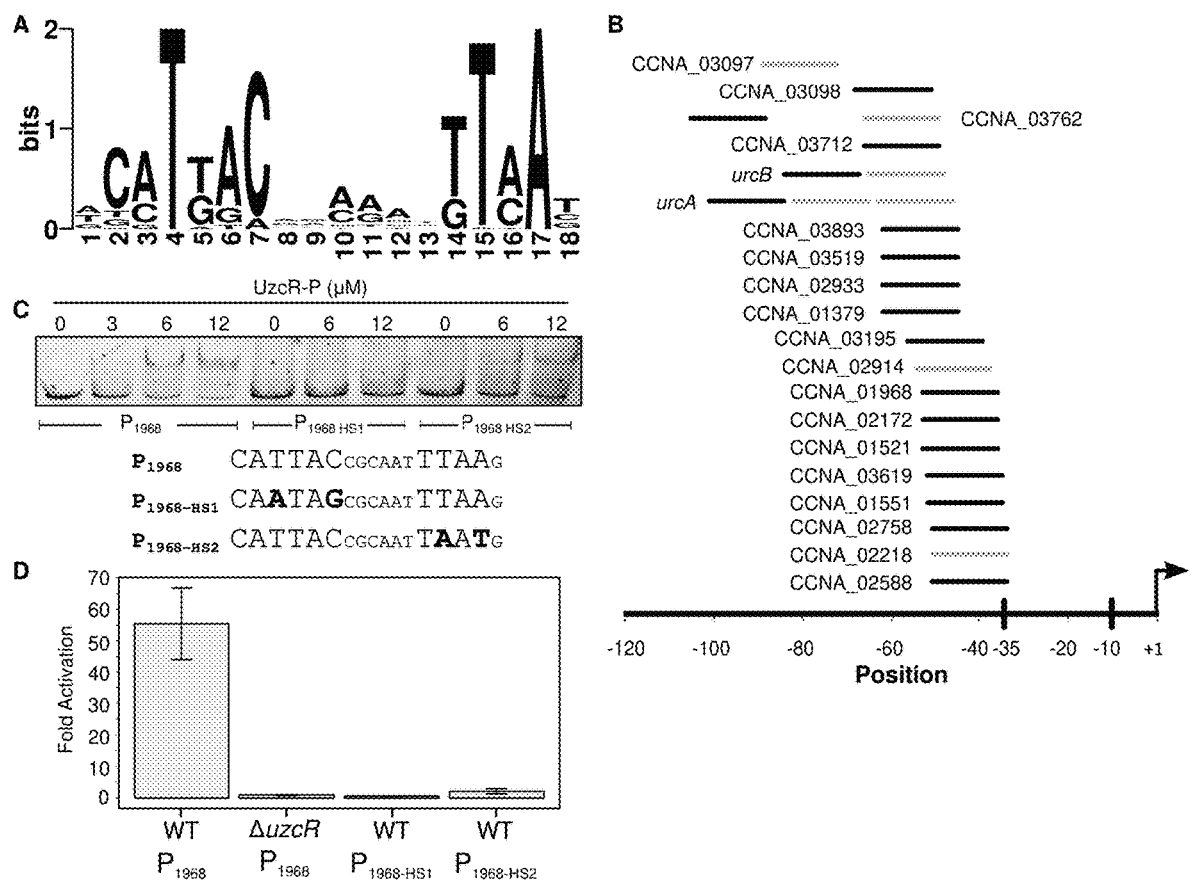
FIG. 25 shows an exemplary identification of the UzcR sequence recognition motif in some embodiments herein described. Panel (A): The 18-bp UzcR (m_5) sequence logo was constructed from the alignment of 49 UzcR boxes identified within the sequence regions bound by UzcR in vivo using MEME [21]. The sequence conservation (bits) is depicted by the height of the letters with the relative frequency of each base depicted by its relative height. Panel (B): Location of the predicted UzcR binding sites with respect to the previously determined Transcription Start Site (TSS) [22] for the directly activated operons. For urcA and urcB, the approximate TSSs as determined by tiled microarray analysis [23] were used. Note that multiple copies of the m_5 motif were found within some binding regions. For urcA and urcB, the approximate TSSs as determined by tiled microarray analysis [23] were used. The length of the line is representative of the length of the binding site with the line color denoting a directional orientation on the coding strand (black) or noncoding strand (gray). Panel (C): EMSA assays of UzcR-P binding to wild type and mutant $P_{1968}$ fragments. Each UzcR half site was individually eliminated by mutation away from consensus (bolded nucleotides). The Assays were performed with 5' 6-FAM-labeled DNA and UzcR-P, generated by phosphorylation of UzcR with carbamoyl phosphate. The concentrations indicate the total UzcR-P used in the assay and arrow depicts the shifted complex. A representative example of three biological replicates is depicted Panel (D): Effects of mutations in each UzcR half site on CCNA_01968 promoter activity in wild type and ΔuzcR backgrounds. Promoter-gfpmut3 fusions with the wild type and mutant $P_{1968}$ fragments described in Panel (B) were constructed and fluorescence was quantified following a two-hour treatment with or without 20 µM Zn using a Biotek plate reader (ex: 480/em: 516). The fluorescence signal was normalized to the $OD_{600}$ and fold activation was calculated by dividing the normalized fluorescence in the presence of Zn by the fluorescence in the uninduced condition. Error bars represent that standard deviation calculated using a formula for propagation of standard error [20] This figure is taken from the Appendix B of U.S. provisional application No. 62/587,753 the disclosure of which is incorporated herein by reference in its entirety.

In some embodiments, one or more m_5 sites are located at a position within 100 nucleotides upstream of the TSS considering the first nucleotide of Seq ID NO: 2 as the first nucleotide of the m_5 site upstream from the TSS (see the position of the first nucleotide (C on the 5' end) of the binding site in FIG. 25 A). In some embodiments, when one or more m_5 sites are located at a position from about −49 upstream of the TSS to +25 downstream of the TSS, in particular, −33 upstream of the TSS to +15 nt downstream of the TSS, the m_5 site is configured for repression of the UzcRS-regulated promoter.

In some embodiments herein described, the U-sensitive promoter is configured such that upon binding of the response regulator UzcR to the m_5 site, the U-sensitive promoter is activated and transcription of a gene operatively connected to the U-sensitive promoter within the related genetic molecular component is initiated.

In other embodiments, the U-sensitive promoter is configured such that upon binding of the U-sensitive transcriptional regulator to the U-sensitive transcriptional UzcR binding site, the U-sensitive promoter is repressed and transcription of a gene operatively connected to the U-sensitive promoter within the related U-sensing genetic molecular component is not initiated. In particular, in some embodiments one or more m_5 sites are located at a position −49 to +25 bp from the TSS considering the first nucleotide of Seq ID NO: 2 as the first nucleotide of the m_5 site upstream from the TSS The approximate range is −49 to +25 bp from the TSS (see the position of the first nucleotide (C on the 5' end) of the binding site (FIG. 25A).

For example, in an exemplary embodiment wherein a promoter is repressed by UzcR, a m_5 site is engineered downstream of a transcription start site of a U-sensitive promoter such as a $P_{1361}$ promoter or $P_{phyt}$ promoter (see Example 2). In these exemplary embodiments, insertion of a m_5 site downstream of the TSS of e.g. $P_{phyt}$ minimizes activation of $P_{phyt}$ in both the presence and absence of U. As would be understood by skilled persons, the latter is preferable as it minimizes UzcRS expression levels when no U is present, minimizing cross-reactivity with Zn and Cu.

Examples of promoters regulated by UzcRS comprise $P_{urcA}$, $P_{urcB}$, $P_{1968}$, and others identifiable by those skilled in the art, such as those described in Park et al., 2017 [3] herein incorporated by reference in its entirety (see also Example 11).

In several embodiments, one or more U-sensing promoters herein described are comprised within a U sensing genetic molecular component which is a genetically engineered polynucleotide construct configured to regulate expression of one or more RNA and/or protein-encoding genes through the one or more U-sensing promoter.

In some embodiments, the U-sensitive promoter includes a 1362 binding site functioning as a binding site for natively expressed U-sensitive transcriptional regulator 1362 and/or a UzcR binding site for natively expressed UzcR. In some embodiments of the U-biosensors herein described, the histidine kinase 1363, and U-sensitive transcriptional regulator 1362 are therefore encoded respectively by 1363 and 1362 genes natively encoded in the genome of the proteobacterial cell and the encoded 1363 and 1362 proteins can be natively expressed in the proteobacterial cell. Similarly, in some embodiments of the U-biosensors herein described, the histidine kinase UzcR, and U-sensitive transcriptional regulator UzcS are therefore encoded respectively by uczR and uczS genes natively encoded in the genome of the proteobacterial cell and the encoded UczR and UczS proteins are natively expressed in the proteobacterial cell.

In other embodiments of $UO_2F_2$-biosensors herein described, 1363 and 1362 genes and/or the uczR and uczS genes are introduced into the proteobacterial cell of (e.g. a species of the subclass Caulobacteridae) within one or more U-sensing regulator genetic molecular components configured to express the proteins 1363 and 1362 and/or UczR and UczS proteins upon activation of a controllable promoter.

In those embodiments, the genetic molecular components comprise the 1363 1362, uczR and/or uczS genes together with one or more regulatory regions configured to directly initiate expression of operatively connected 1363 and 1362 genes and/or operatively connected uczR and uczS genes. In some embodiments, a genetic molecular component introduced into the proteobacterial cell can comprise 1363 and 1362 genes and/or uczR and uczS genes in a same genetic molecular component, while in other embodiments the 1363 gene, the 1362 gene, the uczR gene and/or the uczS gene are comprised in different genetic molecular components. In some embodiments, the one or more regulatory regions operatively connected to the 1363 and/or 1362 genes and/or to the uczR and uczS genes, can comprise any promoter identifiable by skilled persons that is capable of initiating gene expression in a Caulobacteridae cell. Exemplary promoters that can be used to express 1363 and/or 1362 in Caulobacteridae comprise inducible promoter systems such as VanR (regulated by vanillate) and XylR (regulated by xylose), as well as others identifiable by those skilled in the art. In some embodiments, any constitutive promoter identifiable by those skilled in the art that has been characterized as functional to express an operatively linked gene of interest in a proteobacterial species of interest can be used to express 1363 and 1362 and/or uczR and uczS genes in the proteobacterial species of interest.

In some embodiments of the $UO_2F_2$ biosensors described herein wherein one or more genetic molecular components comprising a 1363 gene, 1362 gene, a uczS and/or uczR genes are introduced into a proteobacterial cell, the proteobacterial cell is further genetically engineered so that expression of its native a 1363 gene, 1362 gene, a uzcS and/or uzcR gene is inactivated by gene knockout.

In some embodiments, in the proteobacterial cell, the endogenous genes encoding histidine kinas 1363, transcriptional regulator 1362, histidine kinase UzcS, and/or the U-sensitive transcriptional regulator UzcR are knocked out and the genetically engineered proteobacterial cell is further engineered to include a U-sensing regulator component comprising a gene encoding histidine kinase UzcS, and a gene encoding response regulator UzcR in a configuration wherein the a gene encoding histidine kinase UzcS, and a gene encoding response regulator UzcR are expressed upon activation of a controllable promoter.

In some embodiments, the promoter controlling the expression of the heterologous 1363 gene, the 1362 gene, the UczR gene and/or the UczS gene can be either a constitutively active promoter or an inducible promoter. In preferred embodiments, the promoter is constitutively active.

In some embodiments of the $UO_2F_2$ biosensors described herein wherein one or more genetic molecular components comprising the 1363 and/or 1362 genes and/or the uczR and/or uczS genes are introduced into a proteobacterial cell, the proteobacterial cell is further genetically engineered so that expression of the host endogenous 1363 gene, 1362 gene, uczR gene and/or uczS gene is inactivated by gene knockout. Methods for performing genetic knockout are identifiable by persons skilled in the art, such as gene targeting using techniques such as homologous recombination, or transposon-mediated mutagenesis, or gene editing techniques such as those using CRISPR/Cas9 among others known to those skilled in the art.

In several embodiments, the U sensing genetic molecular component herein described is a genetically engineered polynucleotide construct configured to regulate expression of one or more RNA and/or protein-encoding genes through one or more U-sensing promoter.

In some embodiments herein described, the U-sensitive promoter is configured such that upon binding of the U-sensitive transcriptional regulator 1362 or UzcR to the U-sensitive corresponding binding site, the U-sensitive promoter is activated and transcription of a gene operatively connected to the U-sensitive promoter within the related genetic molecular component is initiated.

In particular, in some embodiments, when the U-sensing promoter comprises a 1362 binding site is located in a position wherein nucleotide $N_{18}$ of the regulator direct repeat (SEQ ID NO: 1) is from about 17 nucleotides upstream of the transcription start site of the genetic molecular component to about 40 nucleotides upstream of the transcription start site of the genetic molecular component, the regulator direct repeat is configured to function as a transcriptional activator binding site.

In other embodiments, the U-sensitive promoter is configured such that upon binding of the U-sensitive transcriptional regulator to the U-sensitive transcriptional 1362 binding site, the U-sensitive promoter is repressed and transcription of a gene operatively connected to the U-sensitive promoter within the related U-sensing genetic molecular component is not initiated.

In particular, in some embodiments, when the U-sensing promoter comprises a 1362 binding site, the 1362 binding site can be located in a position wherein nucleotide $N_1$ of the regulator direct repeat (SEQ ID NO:1) is from about 16 nucleotides downstream of the transcription start site of the genetic molecular component to about 16 nucleotides upstream of the transcription start site of the genetic molecular component or genetic molecular component, the 1362 binding site configured to function as a transcriptional repressor binding site. As would be understood by those skilled in the art, typically, within a given promoter polynucleotide sequence, substitution of a regulator repeat binding site polynucleotide sequence described herein for a promoter polynucleotide sequence comprising a −35 and/or a −10 hexamer sequence of the promoter, or one or more nucleotides at the transcriptional start site or downstream of the transcriptional start site, is expected to provide a promoter comprising a 1362 binding site configured to repress transcription of the promoter.

In preferred embodiments of the U-sensitive genetic molecular component described herein comprising the 1362 binding site, the regulator direct repeat is located in a position wherein nucleotide $N_{15}$ of the regulator direct repeat (SEQ ID NO: 1) is from about 17 nucleotides upstream of the transcription start site of the U-sensing genetic molecular component to about 40 nucleotides upstream of the transcription start site of the genetic molecular component or genetic molecular component, such that the regulator direct repeat is configured to function as a transcriptional activator binding site As understood by those skilled in the art, positions in the promoter are designated relative to the transcriptional start site, where transcription of DNA begins for the gene of interest. Positions upstream (towards the 5' end of the promoter) are negative numbers counting back from −1, for example −10 is a position 10 base pairs upstream of the transcription start site.

The term "transcription start site" or "TSS" as used herein refers to the location where transcription starts at the 5' end of an encoded gene sequence. The location of the transcription start site is typically referred to as +1 relative to the 3' end of a promoter operatively connected to the gene. As would be understood by persons skilled in the art, a putative transcription start site can be detected using techniques such as differential RNA-seq (dRNA-seq) [47], which can differentially detect primary transcripts having triphosphorylated 5' ends, and processed RNAs which do not. Additional techniques to detect transcription start sites known in the art comprise bioinformatic analysis to identify enrichment of promoter elements upstream of a putative transcriptional start site, and experimental validation of selected putative transcription start sites, for example using primer extension methods [48], or by using Northern blots to detect the associated RNAs, among other techniques identifiable by those skilled in the art [49].

In some exemplary embodiments of the U biosensors described herein, the U-sensitive promoter comprising the 1362 binding site is a $P_{1361}$ promoter. The term "$P_{1361}$ promoter" as used herein refers to the promoter that natively regulates expression of an operon comprising CCNA_01361, CCNA_1362 and CCNA_1363 genes in *Caulobacter crescentus*. The DNA sequence of $P_{1361}$ is shown in Table 4.

In some exemplary embodiments of the U biosensors described herein, the U-sensitive promoter comprising the 1362 binding site is a $P_{phyt}$ promoter. The term "$P_{phyt}$ promoter" as used herein refers to the promoter that natively regulates expression of an operon comprising CCNA_01353, CCNA_01352_, and CCNA_01351 genes in *Caulobacter crescentus*. The DNA sequence of $P_{phyt}$ is shown in Table 4. As understood by those skilled in the art, *Caulobacter crescentus* (Poindexter 1964) refers to a Gram-negative, oligotrophic bacterium widely distributed in fresh water lakes and streams. *Caulobacter* is an obligate aerobe with a ubiquitous presence in aqueous environments where it is well-adapted to life under low-nutrient conditions [50]. *Caulobacter* species tolerate high concentrations of U [51, 52], are found in U-contaminated sites [53], and can mineralize U through the formation of uranyl phosphate precipitates [54]. Multi-omics studies to elucidate the U stress response pathways in *C. crescentus* have revealed many highly-induced genes that are not induced by Cd, Cr, Pb or Se [51].

In some embodiments, the U-sensitive promoter is a UzcRS-regulated promoters comprising DNA sequence elements required for RNA Polymerase binding, as well as one or more sequence elements for binding UzcR known as an m_5 site [3], as understood by those skilled in the art and herein also identified as UczR binding site. Examples of promoters regulated by UzcRS comprise $P_{urcA}$, $P_{urcB}$, $P_{1968}$, and others identifiable by those skilled in the art, such as those described in Park et al., 2017 [3].

In embodiments herein described, UzcRS-regulated promoters comprise those having naturally-occurring m_5 sites or m_5 sites that are introduced into a promoter through genetic engineering. Accordingly, UzcRS-regulated promoters comprise DNA sequence elements required for RNA Polymerase binding, as well as one or more m_5 sites, such that the promoter is configured to be regulated by the UzcRS two-component system. Similar to promoters comprising 1362 binding sites, in UzcRS-regulated promoters, the σ-RNAP biding sites typically have low sequence homology to the canonical $σ^{73}$-RNAP −10 and −35 hexamer sequences. Accordingly, typically transcriptional activation of native UzcRS-regulated promoters occurs through binding of UzcR to the promoter, consistent with little observed transcriptional activation in absence of UzcR.

In some embodiments, an UzcRS-regulated promoter can comprise 1-3 copies of the m_5 site. In particular, in some embodiments, when one or more m_5 sites are located at a position from about −34 to about −100 upstream of the TSS, preferably at a position −43 to −53 upstream of the TSS, the m_5 site is configured for activation of the UzcRS-regulated promoter [3]. In other embodiments, when one or more m_5 sites are located at a position from about −33 upstream of the TSS to +15 nt downstream of the TSS, the m_5 site is configured for repression of the UzcRS-regulated promoter.

Accordingly, in some embodiments described herein, a promoter can be either activated or repressed by UzcR. For example, in an exemplary embodiment wherein a promoter is repressed by UzcR, a m_5 site is engineered downstream of a transcription start site of a U-sensitive promoter such as a $P_{1361}$ promoter or $P_{phyt}$ promoter (see Example 2). In these exemplary embodiments, insertion of a m_5 site downstream of the TSS of e.g. $P_{phyt}$ minimizes activation of $P_{phyt}$ in both the presence and absence of U. As would be understood by skilled persons, the latter is preferable as it minimizes UzcRS expression levels when no U is present, minimizing cross-reactivity with Zn and Cu.

In some embodiments, the U-sensitive promoter can be a promoter genetically engineered to comprise the U-sensitive 1362 binding site. In some exemplary embodiments, it is expected that a promoter can be engineered comprising a U-sensitive 1362 binding site having $N_{15}$ of SEQ ID NO: 1 at a position of about −40 to −42 upstream of the transcription start site, as in exemplary promoters $P_{1361}$ and $P_{phyt}$ (see e.g. FIG. 7).

The U-sensitive promoters described herein can further comprise a holo-RNA Polymerase (RNAP) binding site. As understood by those skilled in the art, promoters in bacteria, such as members of Caulobacteridae require DNA sequence elements for 6-RNAP binding for initiation of transcription. In particular, in Caulobacteridae promoters comprising the 1362 binding site such as exemplary promoters $P_{1361}$ and $P_{phyt}$, the σ-RNAP biding site typically have low sequence homology to the canonical $σ^{73}$-RNAP −10 and −35 hexamer sequences. As such, activation of a promoter comprising a 1362 binding site at a position configured for transcriptional activation (e.g. wherein nucleotide $N_{15}$ of the regulator direct repeat is located about −17 to about −40 upstream of the TSS), such as exemplary promoters $P_{1361}$ and $P_{phyt}$, σ-RNAP binding likely requires binding of the U-responsive transcriptional factor to the 1362 binding site, consistent with the observed low level of transcriptional activation in absence of U (see Examples section).

The term "holoenzyme" as used herein refers to enzymes that contain multiple protein subunits, such as RNA polymerases, wherein the holoenzyme is a complete complex containing all the subunits needed for activity. The term "holoenzyme" can also refer to an enzyme together with one or more cofactors required for activity. For example, in bacteria, a promoter is recognized by RNA polymerase (RNAP) and an associated sigma factor, and the complex is referred to as an "RNAP holoenzyme" or "holo-RNAP". An example of a RNAP holoenzyme in Caulobacteridae is RNAP holoenzyme containing σ-$^{73}$.

Figure 2:
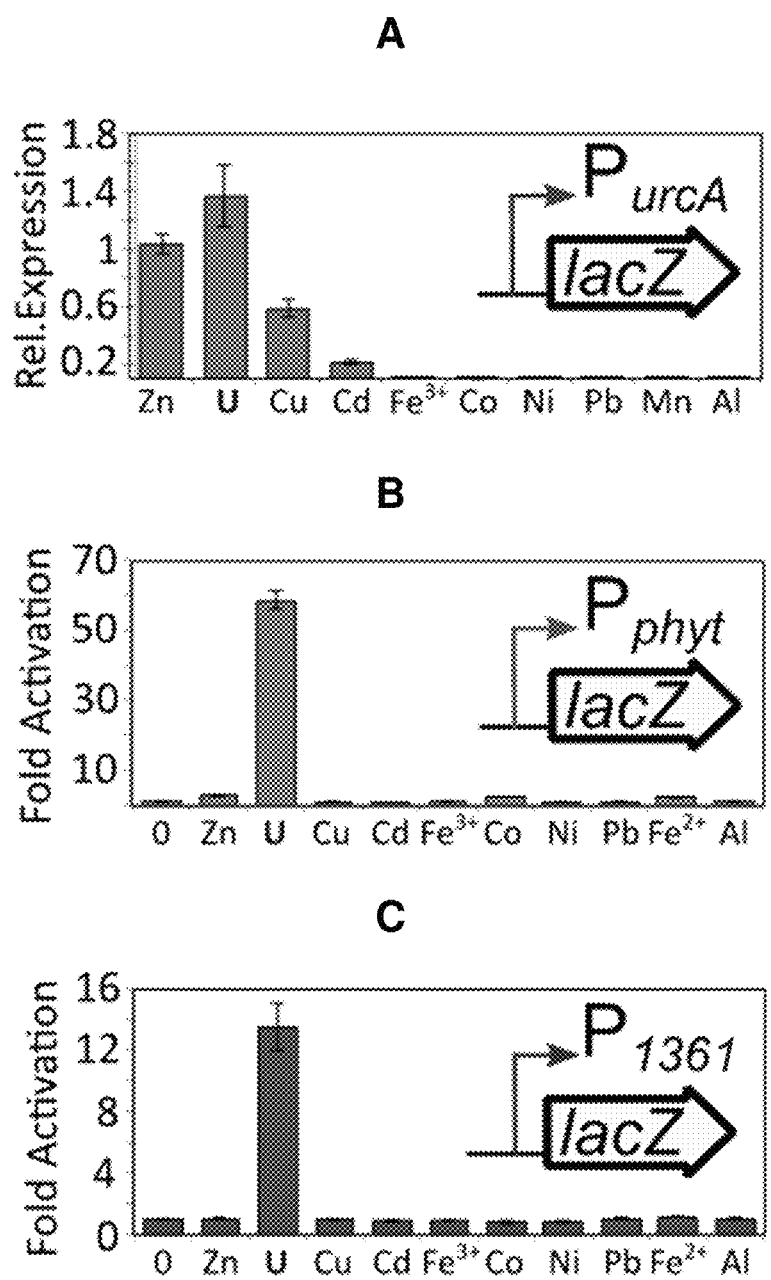
FIG. 2 shows graphs reporting determination of metal specificity of native U-responsive promoters in Caulobacter crescentus. The metal specificity of chromosomal $P_{urcA}$-lacZ (Panel A), $P_{phyt}$-lacZ (Panel B), and $P_{1361}$-lacZ (Panel C) was determined by treating mid-exponential phase cells with a range of concentrations of various metal salts for two hours before determining β-galactosidase activity using the method of Miller [1]. Cell growth was performed in peptone yeast extract (PYE) media supplemented with 50 mM MES pH 6.1. For Panel A, the relative expression was determined by normalizing the β-galactosidase activity observed by treatment with each metal to that of Zn. For Panels A and B, fold activation was calculated by dividing the activity with no added metal from the activity following metal exposure. Error bars represent the standard deviation calculated using a formula for propagation of standard error [2]. See FIG. 23 for more comprehensive metal specificity plot for $P_{urcA}$-lacZ.

The $UO_2F_2$ biosensors comprising the U-sensitive molecular component and/or U-sensitive genetic circuits comprising 1363/1362 TCS and/or UczRS TCS described herein in several embodiments can show improved selectivity for U compared to those previously described, such as in Hillson et al., 2007 [55], as illustrated in the Examples. As shown in FIGS. 1 and 2, the previously unknown exemplary U-responsive *Caulobacter crescentus* promoters $P_{1361}$ and $P_{phyt}$ show highly selective gene expression upregulation in response to U, in contrast to *Caulobacter crescentus* promoter $P_{urcA}$ [55], which also shows upregulation of gene expression in response to other metals such as Zn, Cu and Cd. Accordingly, a U-sensitive promoter, such as a $P_{1361}$ or a $P_{phyt}$ promoter, or a U-sensitive promoter genetically engineered to comprise the U-sensitive 1362 binding site can be used as a stand-alone selective U-sensing promoter.

In a U-sensitive genetic molecular component herein described, the U-Sensing promoter of the present disclosure directly or indirectly controls the expression of a reportable molecular component and/or a U-neutralizing molecular component.

The term "reportable molecular component" as used herein indicates a molecular component capable of detection in one or more systems and/or environments. The terms "detect" or "detection" as used herein indicates the determination of the existence, presence or fact of a target in a limited portion of space, including but not limited to a sample, a reaction mixture, a molecular complex and a substrate. The "detect" or "detection" as used herein can comprise determination of chemical and/or biological properties of the target, including but not limited to ability to interact, and in particular bind, other compounds, ability to activate another compound and additional properties identifiable by a skilled person upon reading of the present disclosure. The detection can be quantitative or qualitative. A detection is "quantitative" when it refers, relates to, or involves the measurement of quantity or amount of the target or signal (also referred as quantitation), which includes but is not limited to any analysis designed to determine the amounts or proportions of the target or signal. A detection is "qualitative" when it refers, relates to, or involves identification of a quality or kind of the target or signal in terms of relative abundance to another target or signal, which is not quantified.

In some embodiments, the reportable molecular component can be a molecular component linked to or comprising a label wherein the term label refers to a compound capable of emitting a labeling signal, including but not limited to radioactive isotopes, fluorophores, chemiluminescent dyes, chromophores, enzymes, enzymes substrates, enzyme cofactors, enzyme inhibitors, dyes, metal ions, nanoparticles, metal sols, ligands (such as biotin, avidin, streptavidin or haptens) and the like. The term "fluorophore" refers to a substance or a portion thereof which is capable of exhibiting fluorescence.

In embodiments of the U-sensitive genetic molecular component described herein, the genetic molecular component comprises a "reporter gene", which can be any genetically-encoded reportable molecular component.

As would be understood by persons skilled in the art, the terms "genetically-encoded reportable molecular component", "reportable genetic molecular component", "genetically encoded reporter" or "reporter gene" comprises polynucleotide-encoded RNA and/or proteins having reportable characteristics identifiable by those skilled in the art and as described herein. Using genetic engineering techniques known to those skilled in the art, a reporter gene can be placed under the regulatory control of a promoter, and expression of the genetically-encoded reportable molecular component thereby serves as an indication of activation of the promoter in a host organism comprising the reporter gene. A reporter gene can be fused to another gene under the regulatory control of the promoter, such as a gene encoding a protein natively regulated by the promoter, so that the promoter regulates the expression of a fusion gene encoding a fusion protein comprised of the natively regulated protein covalently linked to the reportable molecular component. As would be understood by those skilled in the art, it is typical to use a reporter gene that is not natively expressed in the host organism, since the expression of the genetically-encoded reportable molecular component is used as a marker of activation of the promoter in the host organism. Exemplary genetically encoded reportable molecular components comprise fluorescent proteins such as green fluorescent protein (GFP) from *Aequorea victoria* or *Renilla reniformis*, red fluorescent protein from *Discosoma* species (dsRED), and variants thereof, beta galactosidase encoded by lacZ gene, luciferase and others identifiable to those skilled in the art. In exemplary embodiments described herein, exemplary reporters comprise a fluorescent protein which is a mutant variant of GFP referred to as 'gfpmut3' [56].

In some embodiments, the $UO_2F_2$-biosensors comprising U-sensitive genetic molecular components and/or U-sensitive genetic circuits described herein are configured to produce a U-neutralizing molecular component in presence of U.

The term "U-neutralizing molecular component" as used herein refers to any component capable of decreasing the bioavailable U concentration.

In some embodiments, the U-neutralizing molecular component is a U-neutralizing genetic molecular component comprising a "U-neutralizing gene". The term "U-neutralizing genetic molecular component" as used herein refers to a genetic molecular component in which the gene of the genetic molecular component is a U-neutralizing gene and wherein polynucleotide-encoded RNA and/or proteins have U-neutralizing characteristics identifiable by those skilled in the art upon reading of the present disclosure, such as proteins having enzymatic functions capable of allowing bioreduction, biomineralization, biosorption, or bioaccumulation of bioavailable U, as described herein.

The term "bioreduction" as used herein refers to altering the redox state of uranium from aqueous U (VI) to insoluble U (IV). As would be understood by persons skilled in the art, in the absence of oxygen, some bacteria are able to respire different electron acceptors to gain energy for metabolism. As anoxia progresses, the most energetically favorable electron acceptors are used in sequence, starting with the reduction of nitrate, then proceeding through Mn(IV), Fe(III) and sulfate, and finally the reduction of carbon dioxide to produce methane. At circumneutral pH, U(VI) has a similar redox couple to Fe(III), and natively Fe(III)-reducing bacteria are able to respire U(VI) as an alternative electron acceptor, reducing it to insoluble U(IV) [12]. Other groups natively capable of U(VI) reduction comprise bacteria such as sulfate-reducing bacteria [57], fermentative bacteria [58], acid-tolerant bacteria [59] and myxobacteria [60]. In some embodiments where a bioreduction component is comprised in the U-biosensor herein described, the host cell is preferably selected among cells natively expressing the components required to perform uranium bioreduction, which can be engineered to include one or more U-sensing genetic molecular component and/or other components of the U-sensing genetic circuit herein described. In other embodiments, a host cell can be *E. coli* or other facultative anaerobe genetically engineered to include one or more U-sensing genetic molecular component and/or other components of the U-sensing genetic circuit herein described as well as genetic molecular components required to perform U-bioreduction as will be understood by a skilled person Accordingly, in some embodiments uranium bioreduction can be used as a bioremediation technique, stimulated by adding an electron donor to promote enzymatic reduction of aqueous U(VI) to insoluble U(IV) [61-66]. Enzymatic reduction of U(VI) can be catalyzed using U-neutralizing genes such as those expressing cytochrome c [57, 67, 68]. In addition, chelators can be used to solubilize U(VI) and/or electron shuttles to mediate extracellular electron transfer, such as U-neutralizing genes expressing flavin mononucleotide or riboflavin [11, 69-72]. Therefore, in some embodiments of the U biosensors described herein, exemplary U-neutralizing genes comprise cytochrome c genes, flavin mononucleotide genes, or riboflavin genes which can be natively expressed in suitable host possibly further engineered to include one or more U-sensing genetic molecular components and/or U-sensing genetic circuit herein described.

The terms "biomineralization" and "bioprecipitation" as used herein refers to a process by which metals precipitate with microbially generated ligands such as sulfide or phosphate, or as carbonates or hydroxides in response to localized alkaline conditions at the cell surface. Thereafter, the uranium precipitate can be removed. In some embodiments. In some embodiments, the U can be comprised into a stable mineral that sediment out and not be re-leached over time. In addition or in the alternative U-removal can be performed by some form of on-site filtration identifiable by a skilled person. In particular, sequestration of uranium as insoluble uranyl U(VI) phosphate biominerals can be used for in situ biomineralization for sites where bioreduction may not be feasible due to high nitrate concentrations or where there is risk of reoxidation reoccurring, e.g., in sites comprising carbonate [73, 74].

Accordingly, in some embodiments, the $UO_2F_2$-biosensors described herein can be engineered to catalyze precipitation of uranium such as uranyl phosphates. For example, bacteria can be engineered to precipitate uranyl phosphates [75] by expressing U-neutralizing genes such as acid-phosphatase genes [76] or alkaline-phosphatase genes [77] or phytase genes. In some embodiments, an exogenous source of phosphate can be added such as glycerol phosphate [16] or tributylphosphate [78]. Therefore, in some embodiments of the U biosensors described herein, exemplary U-neutralizing genes comprise acid-phosphatase genes, or alkaline-phosphatase genes.

In an exemplary embodiment, the U-neutralizing gene is phoY, encoding an alkaline phosphatase that has been shown to allow the coupling of release of inorganic phosphorus (Pi) from organophosphates with U-Pi precipitation in *Caulobacter crescentus* [54], or phytase, that can be used to liberate phosphate from phytate, an environmental source of phosphate (see Example 10). In some embodiments, Pphyt or P1361 can be used to drive expression of an alkaline phosphatase. In some embodiments, the U-biosensors described herein can be engineered to comprise additional genetic molecular components configured to express one or more genes encoding proteins having enzymatic functions to catalyze release of inorganic phosphate from organophosphates (via hydrolytic cleavage catalyzed by phosphatases), inorganic phosphite (via enzymatic oxidation) and phosphonates (via cleavage catalyzed by C-P lyases), or from nucleic acids [79], phytate [80] or phospholipids [81].

The term "bioaccumulation" as used herein refers to accumulation of metals such as uranium in bacteria. For example, intracellular uranium accumulation occurs as uranyl phosphates in bacteria such as *Pseudomonas* species (Kazy et al., 2009; [82], VanEngelen et al., 2010; [83], Choudhary and Sar, 2011, [84]). In particular, overexpression of the polyphosphate kinase gene (ppk) encoding the PPK enzyme can be used to produce high levels of polyphosphate, a phosphate polymer with chain lengths of two to a few hundred, to allow precipitation of uranyl phosphate at the cell membrane [85]). Accordingly, in some embodiments of the U biosensors described herein, exemplary U-neutralizing genes comprise ppk genes.

The terms "biosorption" or "bioadsorption" as used herein refers to the passive uptake of uranium to the surface of microbial cells, wherein bacterial cell envelopes possess an electronegative charge, so are able to attract metal cations which sorb to the surface. In some embodiments of the U biosensors described herein, exemplary U-neutralizing genes comprise genes encoding proteins configured to bind U to the cell surface of the U biosensor. In an exemplary embodiment, the U-neutralizing gene is an ompA-SUP fusion gene encoding a rationally engineered super uranyl binding protein (SUP) having femtomolar affinity [86] (see Example 10). The encoded ompA fusion is configured to anchor SUP to the outer membrane, allowing adsorption of U to the cell surface. In other exemplary embodiments, the U-neutralizing gene is a fusion gene comprising the ompA protein fused to a Calmodulin EF-Hand Peptide (CaM) [87] that has been engineered for high U selectivity. In other exemplary embodiments, the U-neutralizing gene is a fusion gene comprising the Calmodulin EF-Hand Peptides (CaM) or SUP fused with the rsaA (S-layer) gene (see Example 10), for example using the method outline in Nomellini [88]. Accordingly, in some embodiments, proteobacteria can be engineered to provide U biosensors comprising U-neutralizing components configured to produce a U biosorption output, following a methodology such as has been used in *Caulobacter* for rare earth element adsorption [89].

Accordingly, $UO_2F_2$-biosensors comprising U-neutralizing molecular components described herein can be used in several embodiments for U bioremediation.

The term "bioremediation" as used herein refers to a waste management technique that involves the use of organisms to neutralize pollutants from a contaminated site. Bioremediation can be performed in situ or ex situ. In situ bioremediation involves treating the contaminated material at the site, while ex situ involves the removal of the contaminated material to be treated elsewhere.

Figure 15:
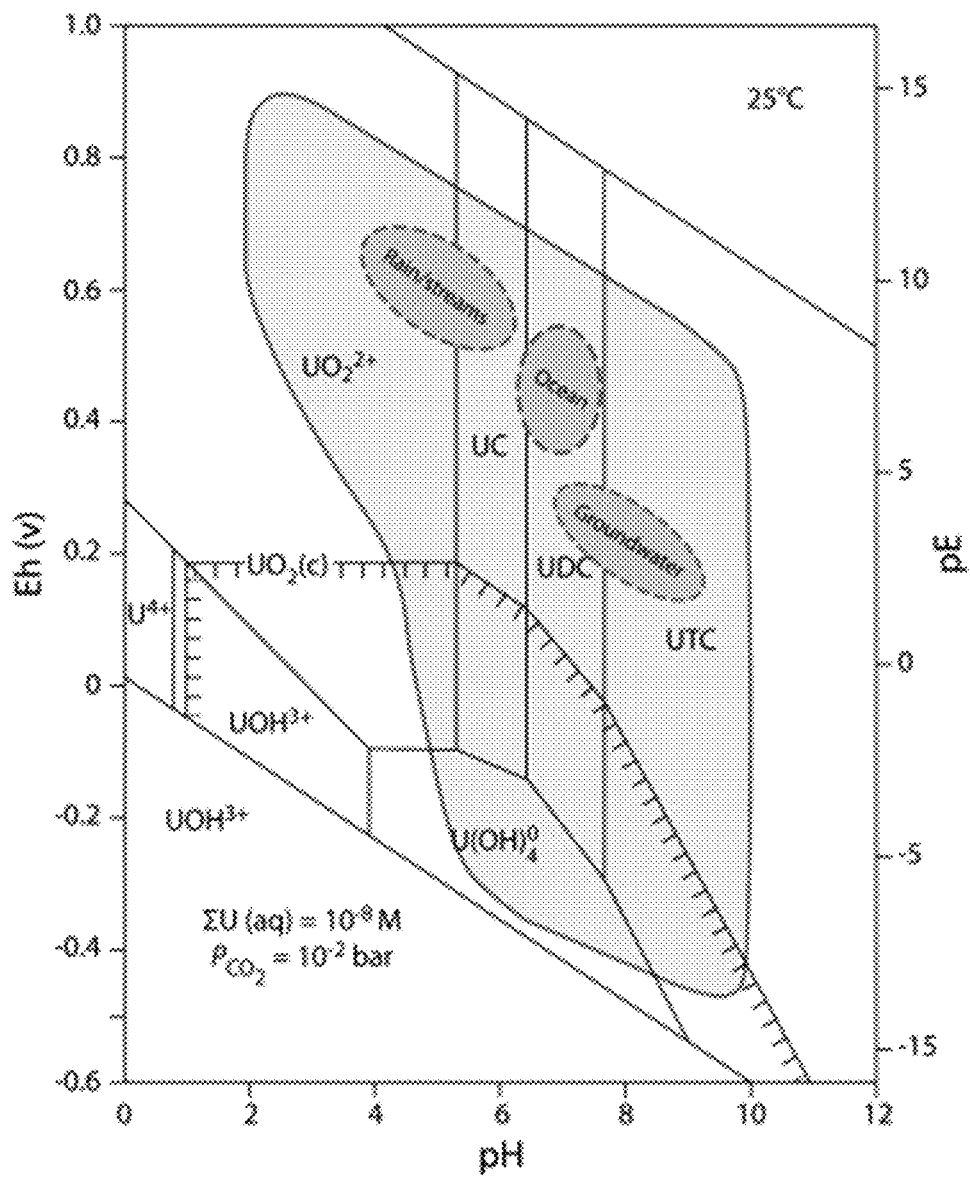
FIG. 15 is FIG. 1 from Newsome et al. (2014) [7] showing an exemplary Eh-pH diagram (which maps out possible stable (equilibrium) phases of an aqueous electrochemical system) for aqueous species in the U—$O_2$—$CO_2$—$H_2O$ system in pure water at 25° C. and 1 bar total pressure for $\Sigma U=10^{-8}$ M and a typical groundwater $CO_2$ pressure of $PCO_2=10^{-2.0}$ bar [8]. UC, UDC and UTC represent the aqueous complexes $UO_2CO_3^0$, $UO_2(CO_3)_2^{2-}$ and $UO_2(CO_3)_3^{4-}$. The position of the $UO_2$(c) solid solution boundary for $\Sigma U=10^{-8}$ M is stippled. The shaded area represents the range of conditions of common natural waters [9] as presented in Newsome et al., (2014) [7].
Figure 16A:
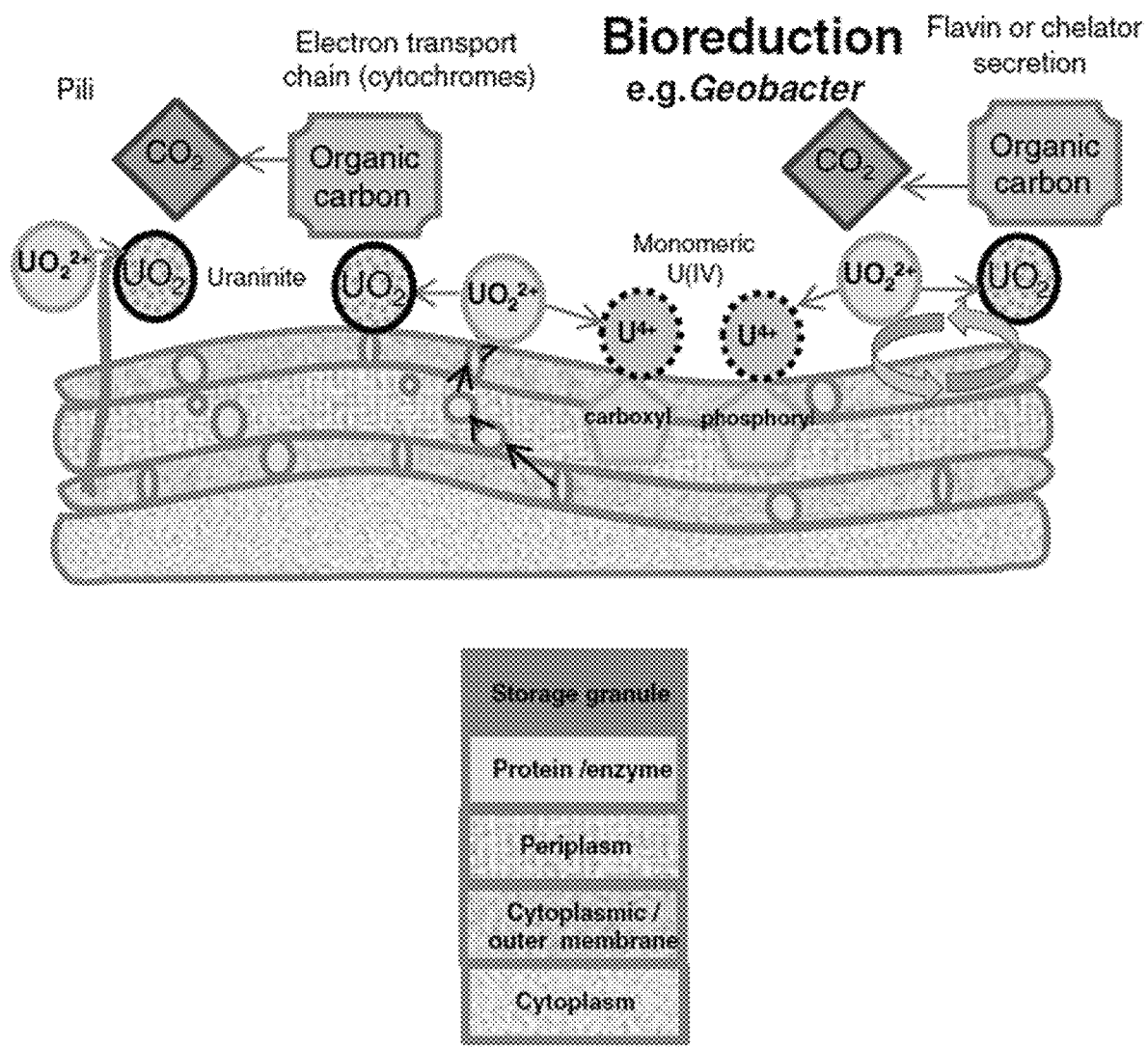
FIG. 16A is from FIG. 2 of Newsome et al. (2014) [7] showing a schematic illustrating exemplary mechanisms of microbe-uranium interactions, such as bioreduction [10-13].

As would be understood by persons skilled in the art, mobility of uranium in the environment depends on its speciation and redox state (e.g., see FIG. 15). It is present as mobile U(VI) in oxidizing conditions, predominantly as the uranyl ion ($UO_2^{2+}$) or hydroxyl complexes below ~pH 6.5, or as uranyl carbonate complexes at higher pH [90]. In the absence of carbonate, the uranyl ion and its complexes sorb strongly onto the surface of iron oxides and organics [73, 91, 92] and onto the edge sites of clay minerals [93, 94]. Sorption decreases in the presence of complexing ligands such as humic and fulvic acids, and in the presence of competing cations such as $Ca^{2+}$ and $Mg^{2+}$ [95]. Under reducing conditions, relatively insoluble and immobile U(IV) predominates, typically as the mineral uraninite, or as other U(IV) minerals [10, 96].

Biogeochemical interactions play a key role in controlling the speciation and mobility of uranium, through direct metabolic processes such as microbial respiration, or indirectly by changing ambient redox/pH conditions, producing ligands or new biominerals, or altering mineral surfaces. In addition to controlling uranium mobility via "natural attenuation", these biogeochemical processes can be stimulated to accelerate clean-up of contaminated environments through bioremediation.

Preventing uncontrolled dispersion and transport of uranium in groundwater is a primary remediation goal at contaminated sites. Accordingly, stimulating bacterial interactions to fix aqueous uranium into insoluble minerals in situ can provide a relatively inexpensive and non-intrusive solution to remediating uranium contamination. Exemplary mechanisms of different microbe-uranium interactions are illustrated in FIGS. 16A-D, comprising bioreduction, biomineralization, biosorption, and bioaccumulation [7], among other identifiable by those skilled in the art.

In embodiments of the $UO_2F_2$-biosensors described herein configured to have a U-neutralizing molecular component output to perform a U bioremediation function in response to bioavailable U, the preferred U-neutralizing molecular component output is a U-neutralizing molecular component having a U biomineralization function.

In some embodiments of a U-sensing genetic molecular component, the reporter gene or U-neutralization gene is contiguous with the U-sensitive promoter, wherein the 5' end of the reporter gene is immediately adjacent to the 3' end of the U-sensitive promoter. In other embodiments, the reporter gene is not contiguous with the promoter, such that one or more nucleotides are located between the 3' end of the U-sensitive promoter and the 5' end of the reporter gene. For example, in some embodiments, a ribosome binding site can be inserted between the 3' end of the U-sensitive promoter (downstream of the TSS) and the 5' end of the reporter gene.

In some embodiments, the U biosensors described herein comprise any non-pathogenic member of Caulobacteridae. In some embodiments described herein, the U biosensor comprises Caulobacteridae such as *C. crescentus* strains NA1000, CB15, and OR37, an environmental isolate from a U-contaminated site that exhibits high heavy metal tolerance [97]. In Examples provided herein, an exemplary host organism is *C. crescentus* strain NA1000.

In some embodiments of the U biosensor described herein, the cell can be any Caulobacteridae having a genome that natively comprises promoters having 1362 binding sites, such as exemplary promoters $P_{1361}$ or $P_{phyt}$, or a homolog thereof.

In the $UO_2F_2$-biosensor of the instant disclosure, the U biosensor herein described is further engineered to include an F-sensing riboswitch.

The term "riboswitch" in the sense of the disclosure indicates a regulatory segment of a messenger RNA molecule that is configured to bind a target compound and to provide upon binding with the target compound a change in production of the proteins encoded by the mRNA. Accordingly, a riboswitch sense concentrations of the target compound. [98].

Riboswitches in the sense of the disclosure comprise an aptamer domain which is configured to specifically and selectively bind the target compound and an expression platform domain configured for genetic control of the mRNA expression. In particular, a riboswitch is configured so that in absence of the target compound the aptamer domain and the expression platform domain are configured to inhibit the expression of the mRNA. In a riboswitch in the sense of the disclosure upon binding of the target compound with the aptamer domain the riboswitch changes configuration and in the expression platform domain's inhibition of the mRNA expression is removed, thus providing in metabolite-dependent allosteric control of gene expression.

In particular, aptamer domains are typically configured to form a stem structure in absence of the target compound. The hybridizing strands forming the stem are referred to as the aptamer strand and the control strand which are configured to complementarily bind to each other. In a riboswitch the stem structure which is either formed or be disrupted in absence of target compound is an aptamer domain-control strand stem structure.

In a riboswitch, expression platform domains generally have at least a portion identified as regulated strand configured to complementarily bind with the control strand of a linked aptamer domain to form a control strand-regulated strand structure, which can be a control strand-regulated strand stem. This control strand regulated strand structure will either form or be disrupted upon binding of the target compound.

Thus, the control strand of the aptamer domain can complementarily bind to with the aptamer strand and the regulated strand to form alternative stem structures with the aptamer strand and the regulated strand of the expression platform domain depending on the presence of the target domain.

The term 'complementary bind", "base pair", "complementary base pair" as used herein with respect to nucleic acids indicates the two nucleotides on opposite polynucleotide strands or sequences that are connected via hydrogen bonds. For example, in the canonical Watson-Crick DNA base pairing, adenine (A) forms a base pair with thymine (T) and guanine (G) forms a base pair with cytosine (C). In RNA base paring, adenine (A) forms a base pair with uracil (U) and guanine (G) forms a base pair with cytosine (C). Accordingly, the term "base pairing" as used herein indicates formation of hydrogen bonds between base pairs on opposite complementary polynucleotide strands or sequences following the Watson-Crick base pairing rule as will be applied by a skilled person to provide duplex polynucleotides. Accordingly, when two polynucleotide strands, sequences or segments are noted to be binding to each other through complementarily binding or complementarily bind to each other, this indicate that a sufficient number of bases pairs forms between the two strands, sequences or segments to form a thermodynamically stable double-stranded duplex, although the duplex can contain mismatches, bulges and/or wobble base pairs as will be understood by a skilled person.

In particular, in the riboswitch, complementary binding between the aptamer strand and the control strand is more or less thermodynamically stable than complementary base paring between the aptamer strand and other sequences of the riboswitch, and complementary binding between the control strand with the regulated strand of the riboswitch, depending on the presence of the target compound.

The term "thermodynamic stability" as used herein indicates a lowest energy state of a chemical system. Thermodynamic stability can be used in connection with description of two chemical entities (e.g. two molecules or portions thereof) to compare the relative energies of the chemical entities. For example, when a chemical entity is a polynucleotide, thermodynamic stability can be used in absolute terms to indicate a conformation that is at a lowest energy state, or in relative terms to describe conformations of the polynucleotide or portions thereof to identify the prevailing conformation as a result of the prevailing conformation being in a lower energy state. Thermodynamic stability can be detected using methods and techniques identifiable by a skilled person. For example, for polynucleotides thermodynamic stability can be determined based on measurement of melting temperature $T_m$, among other methods, wherein a higher $T_m$ can be associated with a more thermodynamically stable chemical entity as will be understood by a skilled person. Contributors to thermodynamic stability can include, but are not limited to, chemical compositions, base compositions, neighboring chemical compositions, and geometry of the chemical entity.

Typically, in a riboswitch, the formation of the control strand-regulated strand structure affects expression of the RNA molecule containing the riboswitch.

The stem structure generally either is, or prevents formation of, an expression regulatory structure. An expression regulatory structure is a structure that allows, prevents, enhances or inhibits expression of an RNA molecule containing the structure. Examples include Shine-Dalgarno sequences, initiation codons, transcription terminators, and stability and processing signals, such as splice sites and sequences.

Riboswitches in the sense of the disclosure can be naturally occurring, isolated and recombinant riboswitches. Microbes, in particular, bacteria and archea, have evolved riboswitches to selectively detect over a dozen small molecules/metabolites (e.g., purine nucleobases) [99], several of which have been exploited for the construction of whole-cell biosensors [100].

Riboswitches in the sense of the disclosure can be comprised in sequences encoding proteins or peptides of interest, including reporter proteins or peptides, which can naturally occurring or synthetic as well as endogenous or heterologous to the host cell.

The term "F-sensing riboswitch" as used herein indicates a riboswitch for which Fluoride is the target compound. Accordingly, F-sensing riboswitches in the sense of the disclosure function as riboswitches that sense fluoride ions. These F-sensing riboswitches increase expression of downstream genes when fluoride levels are elevated, and the downstream genes can modulate the toxic effects of high levels of fluoride.

An F-sensing riboswitch comprises a fluoride aptamer domain which is configured to specifically and selectively bind fluoride and an expression platform domain configured for genetic control of the mRNA expression. An F-sensing riboswitch in accordance with the disclosure is configured so that in the absence of fluoride the fluoride aptamer domain and the expression platform domain are configured to inhibit the expression of the mRNA. Upon binding of fluoride with the aptamer domain the F-sensing riboswitch changes configuration and the inhibition of the mRNA expression imposed by the expression platform domain is thus removed.

In embodiments herein described the fluoride aptamer is expected to bind fluoride anions with a dissociation constant of between 50 μM and 60 μM, inclusive and to be able to detect an amount of fluoride in the environment, which can be calculated accordingly. In particular, the dissociation constant is particularly useful for determining the amount of fluoride detectable in the environment if the fluoride export capability of the host is abolished (when fluoride is retained inside the cell rather than pumped back out) as will be understood by a skilled person.

Fluoride detection capability of specific riboswitches is expected to be identified using approaches such as the ones exemplified in Example 20 and Example 22 as will be understood by a skilled person. In an example, following identification of a suitable host, the host genome can be searched to identify presence or absence of a native fluoride riboswitch such as a CrcB or EricF homolog. If a native fluoride riboswitch is present, the detection limit for a biosensor of the disclosure is expected to be close to 1 mM. In those instances, deletion of the fluoride transporter will likely enable a 100-fold decrease in the detection limit. Accordingly, host cell not expressing a native fluoride riboswitch or with a deleted native riboswitch is expected to be able to detect about 10 μM or higher. It is expected that levels such as 50 μM and 60 μM fluoride will not substantially affect the viability of cells lacking fluoride efflux activity and that toxicity for a host will require mM levels of Fluoride depending on the host as will be understood by a skilled person.

As used herein, "fluoride aptamer domains" or "fluoride aptamers" indicate nucleic acid molecules that can specifically bind to fluoride ions. In an F-sensing riboswitch the fluoride aptamer domain is typically configured in a stem structure formed by the fluoride aptamer strand complementarily binding the control strand of the fluoride sensing riboswitch or in an alternative stem structure with the fluoride regulated strand of the expression platform domain or other sequences designed to complementarily bind the fluoride control strand depending on the presence of absence or fluoride according to the riboswitch design.

In particular, Fluoride aptamers typically are configured to form a stem structure in absence of fluoride. Fluoride aptamers include nucleic acid molecules that bind fluoride as the anion alone or fluoride with a counterion. Fluoride aptamers generally can be naturally occurring fluoride aptamers, such as fluoride aptamers in naturally-occurring F-sensing riboswitches, and fluoride aptamers derived from naturally-occurring fluoride aptamers.

A general sequence for F-sensing riboswitches is (SEQ ID NO: 2509)
$N_1N_2N_3N_4N_5N_6N_7N_8N_9G_{10}G_{11}N_{12}R_{13}A_{14}U_{15}G_{16}R_{17}N_{18}U_{19}R_{20}U_{21}Y_{22}C_{23}Y_{24}$ $N_{25}C_{26}C_{27}N_{28}R_{29}N_{30}N_{31}N_{32}N_{33}N_{34}N_{35}C_{36}C_{37}A_{38}U_{39}C_{40}N_{41}R_{42}R_{43}N_{44}S_{45}N_{46}$ $N_{47}N_{48}N_{49}N_{50}N_{51}N_{52}N_{53}N_{54}N_{55}N_{56}N_{57}N_{58}N_{59}N_{60}W_{61}N_{62}N_{63}N_{64}N_{65}N_{66}N_{67}N_{68}$ $M_{69}N_{70}R_{71}R_{72}N_{73}N_{74}M_{75}U_{76}G_{77}M_{78}Y_{79}R_{80}G_8 \cdot C_{82}M_{83}R_{84}Y_{85}M_{86}W_{87}R_{88}A_{89}A_{90}$ $S_{91}N_{92}N_{93}N_{94}N_{95}N_{96}N_{97}N_{98}N_{99}N_{100}N_{101}N_{102}N_{103}N_{104}N_{105}M_{106}N_{107}M_{108}N_{109}$ $N_{110}N_{111}N_{112}N_{113}Y_{114}N_{115}N_{116}A_{117}A_{118}U_{119}U_{120}C_{121}C_{122}G_{123}C_{124}Y_{125}N_{126}$ $N_{127}N_{128}N_{129}N_{130}N_{131}N_{132}G_{133}N_{134}A_{135}G_{136}N_{137}N_{138}N_{139}N_{140}N_{141}N_{142}N_{143}$ $N_{144}N_{145}N_{146}N_{147}N_{148}N_{149}N_{150}N_{151}N_{152}N_{153}N_{154}W_{155}N_{156}N_{157}N_{158}N_{159}N_{160}$ $N_{161}M_{162}N_{163}N_{164}A_{165}N_{166}N_{167}N_{168}N_{169}N_{170}N_{171}N_{172}N_{173}N_{174}N_{175}N_{176}N_{177}$ $N_{178}N_{179}N_{180}N_{181}N_{182}N_{183}N_{184}N_{185}N_{186}N_{187}N_{188}N_{189}N_{190}N_{191}N_{192}C_{193}U_{194}$ $W_{195}M_{196}N_{197}N_{198}N_{199}N_{200}N_{201}N_{202}N_{203}N_{204}N_{205}N_{206}N_{207}N_{208}N_{209}N_{210}N_{211}$ $N_{212}N_{213}R_{214}G_{215}C_{216}U_{217}R_{218}A_{219}U_{220}G_{221}R_{222}Y_{223}Y_{224}Y_{225}C_{226}U_{227}R_{228}$ $Y_{229}N_{230}N_{231}N_{232}N_{233}N_{234}N_{235}$, wherein
any one of $N_2$, $N_3$, $N_4$, $N_5$, $N_6$, $N_7$, $N_8$, $N_9$, $N_{31}$, $N_{32}$, $N_{33}$, $N_{34}$, $N_{35}$, $N_{47}$, $N_{48}$, $N_{49}$, $N_{50}$, $N_{51}$, $N_{52}$, $N_{53}$, $N_{54}$, $N_{55}$, $N_{56}$, $N_{57}$, $N_{58}$, $N_{59}$, $N_{60}$, $N_{63}$, $N_{64}$, $N_{65}$, $N_{66}$, $N_{67}$, $N_{68}$, $N_{93}$, $N_{94}$, $N_{95}$, $N_{96}$, $N_{97}$, $N_{98}$, $N_{99}$, $N_{100}$, $N_{101}$, $N_{102}$, $N_{103}$, $N_{104}$, $N_{105}$, $N_{108}$, $N_{109}$, $N_{110}$, $N_{111}$, $N_{112}$, $N_{113}$, $N_{127}$, $N_{128}$, $N_{129}$, $N_{130}$, $N_{131}$, $N_{132}$, $N_{138}$, $N_{139}$, $N_{140}$, $N_{141}$, $N_{142}$, $N_{143}$, $N_{144}$, $N_{145}$, $N_{146}$, $N_{147}$, $N_{148}$, $N_{149}$, $N_{150}$, $N_{151}$, $N_{152}$, $N_{153}$, $N_{154}$, $N_{167}$, $N_{168}$, $N_{169}$, $N_{170}$, $N_{171}$, $N_{172}$, $N_{173}$, $N_{174}$, $N_{175}$, $N_{176}$, $N_{177}$, $N_{178}$, $N_{179}$, $N_{180}$, $N_{181}$, $N_{182}$, $N_{183}$, $N_{184}$, $N_{185}$, $N_{186}$, $N_{187}$, $N_{188}$, $N_{189}$, $N_{190}$, $N_{191}$ $N_{192}$, $N_{231}$, $N_{232}$, $N_{233}$, $N_{234}$, and $N_{235}$ indicated in the sequence in bold fonts, can be independently present or absent;

R indicates a purine (A or G).
Y indicates a pyrimidine (C or U).
N indicates any nucleotide
W indicates a weak nucleotide (A or U).

S, indicates a strong nucleotide (G or C).

M, indicates an amino nucleotide (A or C).

Figure 43:
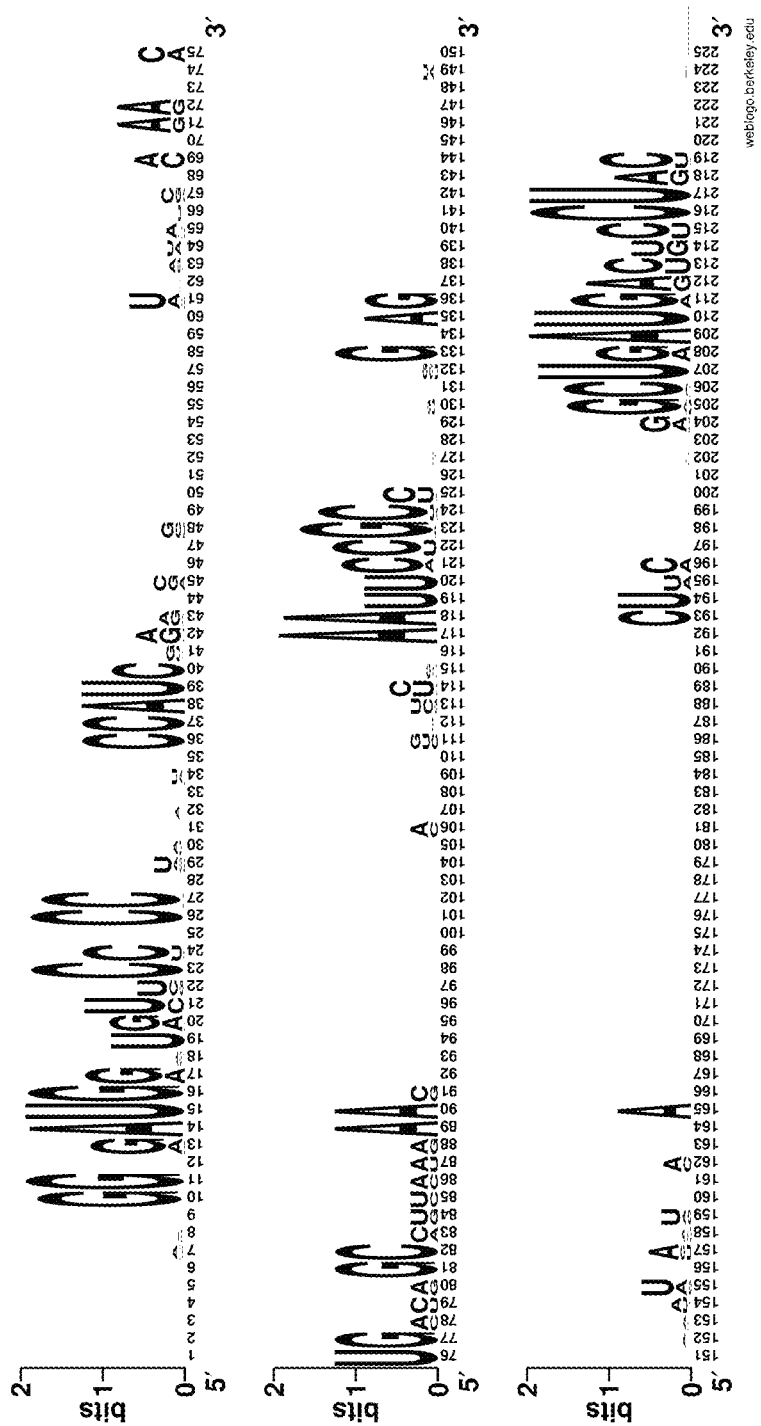
FIG. 43 shows the conserved nucleotides in naturally occurring Fluoride sensing riboswitchs from a gapped alignment of the 2138 fluoride riboswitch sequences from the Rfam database

K, Keto (G or U).

as also illustrated in FIG. 43, This sequence, like any other riboswitch, is encoded by a corresponding DNA sequence wherein U is replaced by T as will be understood by a skilled person. This sequence further provides an indication of the conserved nucleotides in naturally occurring Fluoride sensing riboswitches as will be understood by a skilled person.

Exemplary F-sensing riboswitches in the sense of the disclosure comprise a fluoride-sensing riboswitch called a 'crcB motif' [102, 103]. crcB motif RNAs are typically located upstream of genes encoding proteins of diverse functions and presumably regulate these genes. Some of the gene products are annotated as ion transporters (for example, chloride, sodium, proton) and some others are involved in various physiological (e.g., universal stress adaptation, DNA repair) or metabolic (e.g., enolase, formate-hydrogen lyase) processes. The crcB riboswitch, in particular, enables a mechanism for sensing and detoxifying environmental fluoride by coupling fluoride binding [104] with the activation of genes encoding enzymes that mitigate fluoride toxicity, most commonly a fluoride exporter (CrcB) that expels internal fluoride anions [102, 105](see Example 26). A key feature of the crcB motif is the high fluoride selectivity; binding has not been observed for other halides (including concentrations of chloride up to 2.5 M), small anions, gases and 36 other relevant cellular metabolites [102]. Furthermore, examination of crcB riboswitch function within a modified *Escherichia coli* strain revealed a fluoride detection limit below 10 µM (sub-500 ppb) and a dynamic range that spanned two orders of magnitude [102] (see Example 26). Collectively, these data support the conclusion that crcB motif can be applied toward the environmental detection of fluoride, and ultimately, function as an integral detection component within a whole-cell $UO_2F_2$ compound sensor.

Exemplary fluoride riboswitches, as well as related structures functions and locations in genomes are described in U.S. Pat. No. 9,580,713 incorporated herein by reference in its entirety. [102] as well as in the papers Zao et al, 2017 [106], Ren et al 2012 [104] and Park and Taffet 2019 [107] each of which is herein also incorporated by reference in its entirety.

Figure 48A:
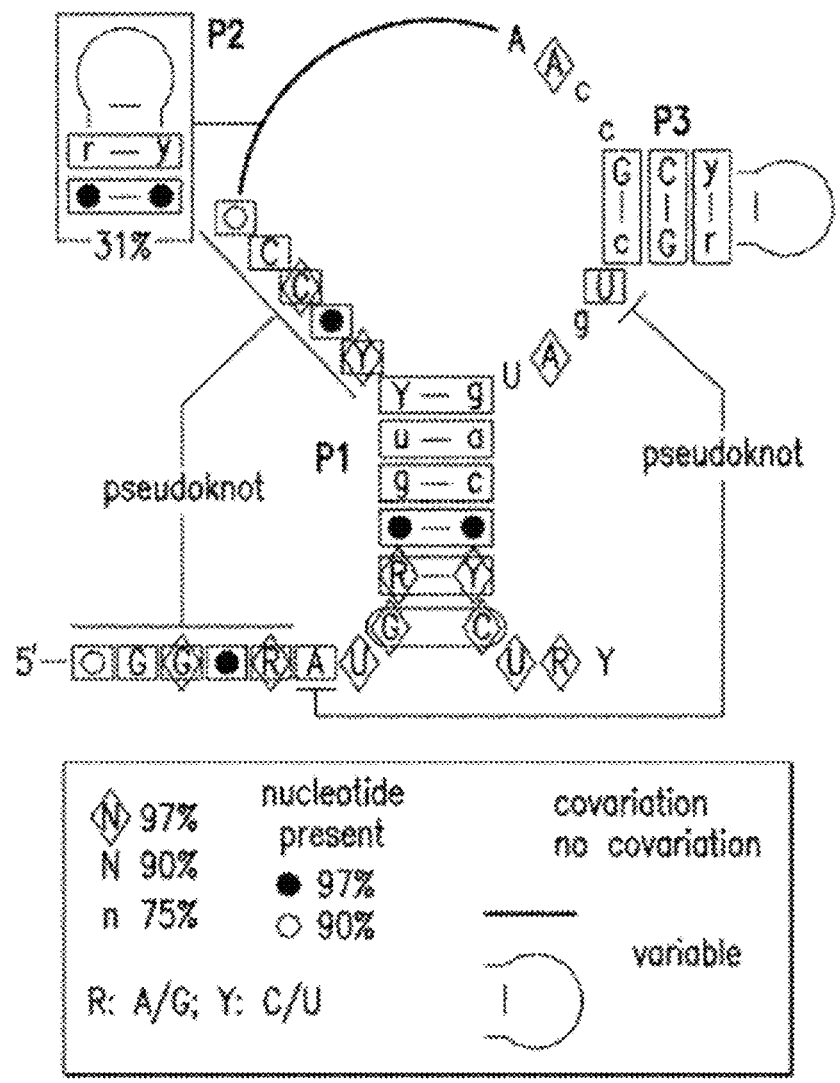
FIG. 48A is FIG. 1A of U.S. Pat. No. 9,580,713 and, as indicated in U.S. Pat. No. 9,580,713 shows a schematic representation of "the consensus sequence and structural model based on the comparison of 2188 representatives from bacterial and archaeal species". As indicated in U.S. Pat. No. 9,580,713 incorporated herein by reference in its entirety "P1, P2, P3 and pseudoknot labels identify base-paired substructures. Note that the bottom of P1 carries a possible G-C pair. However, because noncomplementary nucleotides occur in these positions in some representatives, these nucleotides are depicted as unpaired."

In particular, an exemplary consensus sequence and structure for crcB motif RNAs is shown in FIG. 48A which reproduces FIG. 1A of U.S. Pat. No. 9,580,713 [102] incorporated herein by reference in its entirety.

In particular, FIG. 48A shows a consensus sequence and structural model based on the comparison of 2188 representatives from bacterial and archaeal species. P1, P2, P3 and pseudoknot labels of FIG. 1A of U.S. Pat. No. 9,580,713 [102] identify base-paired substructures. As used herein, a pseudoknot is a nucleic acid secondary structure containing at least two stem-loop structures in which half of one stem is intercalated between the two halves of another stem as will be understood by a person skilled in the art.

Exemplary F-sensing riboswitches with a consensus sequence and structure schematically illustrated in FIG. 48A has sequence (SEQ ID NO: 2510)
$N_1G_2\ G_3\ N_4\ R_5\ A_6\ U_7\ G_8\ R_9\ N_{10}\ G_{11}\ U_{12}\ Y_{13}\ Y_{14}\ N_{15}\ C_{16}\ G_{30}$ $C_{17}\ N_{18}\ A_{19}\ A_{20}\ C_{21}\ C_{22}\ G_{23}\ C_{24}\ Y_{25}\ R_{26}\ G_{27}\ C_{28}\ U_{29}\ A_{31}\ U_{32}$ $G_{33}\ A_{34}\ C_{35}\ N_{36}\ Y_{37}\ C_{38}\ U_{39}\ R_{40}\ Y_{41}$ wherein $N_1\ N_4\ N_{10}\ N_{15}\ N_{15}\ N_{18}$ and $N_{36}$ are independently any amino acid;

N $N_4\ N_4\ N_{10}\ N_{15}\ N_5\ N_{18}$ and $N_{36}$ are independently present or absent;

anyone of $N_1G_2\ G_3\ N_4\ R_5$ is linked with any one of $Y_{14}\ N_{15}\ C_{16}\ C_{17}\ N_{18y}$ by a pseudoknot $A_6$ is linked with $U_{29}$ by a pseudoknot a first insertion segment of variable length is located between $N_{18}$ and $A_{19}$, the first insertion segment comprising a stem loop structure of variable length and having sequence starting with NR and ending with YN in a 5' to 3' direction a second insertion segment of variable length is located between $Y_{25}$ and $R_{26}$; second insertion segment configured to form a stem loop structure R is A or G; and Y is C or U as also indicated in FIG. 48A In F-sensing riboswitches of sequence SEQ ID NO: 2510, any one of nucleotides G3, $R_5$, $U_7$, $G_8$, $R_9$, $Y_{14}$, $C_{16}$, $A_{20}$, $A_{31}$, $Y_{37}$, $C_{38}$, $U_{39}$, and $R_{40}$ is a 97% conserved nucleotide (present in 97% of the F-sensing riboswitches encompassed by SEQ ID NO: 2510)

In F-sensing riboswitches of sequence SEQ ID NO: 2510, any one of nucleotides $G_2$, $G_3$, $R_5$, $A_6$, $U_7$, $G_8$, $R_9$, $Y_{14}$, $C_{16}$, $C_{17}$, $A_{19}$, $A_{20}$, $G_{23}$, $C_{24}$, $G_{27}$, $U_{29}$, $A_{31}$, $Y_{37}$, $C_{38}$, $U_{39}$, $R_{40}$ and $Y_{41}$ is a 90% conserved nucleotide (present in 90% of the F-sensing riboswitches encompassed by SEQ ID NO: 2510)

In F-sensing riboswitches of sequence SEQ ID NO: 2510, any one of nucleotides $G_{11}$, $U_{12}$, $Y_{13}$, $C_{21}$, $C_{22}$, $Y_{25}$, $R_{26}$, $C_{28}$, $G_{30}$, $G_{33}$, $A_{34}$, and $C_{35}$ is a 75% conserved nucleotide (present in 75% of the F-sensing riboswitches encompassed by SEQ ID NO: 2510W)

An additional, exemplary consensus sequence and structure for crcB riboswitches is reported in FIG. 48. FIG. 48B reproduces FIG. 1B of U.S. Pat. No. 9,580,713 [102] and shows an exemplary sequence and secondary structure model for the WT 78 Psy RNA comprising a crcB motif sequence. The 78-nucleotide RNA encompasses the crcB motif from *Pseudomonas syringae*.

Figure 48B:
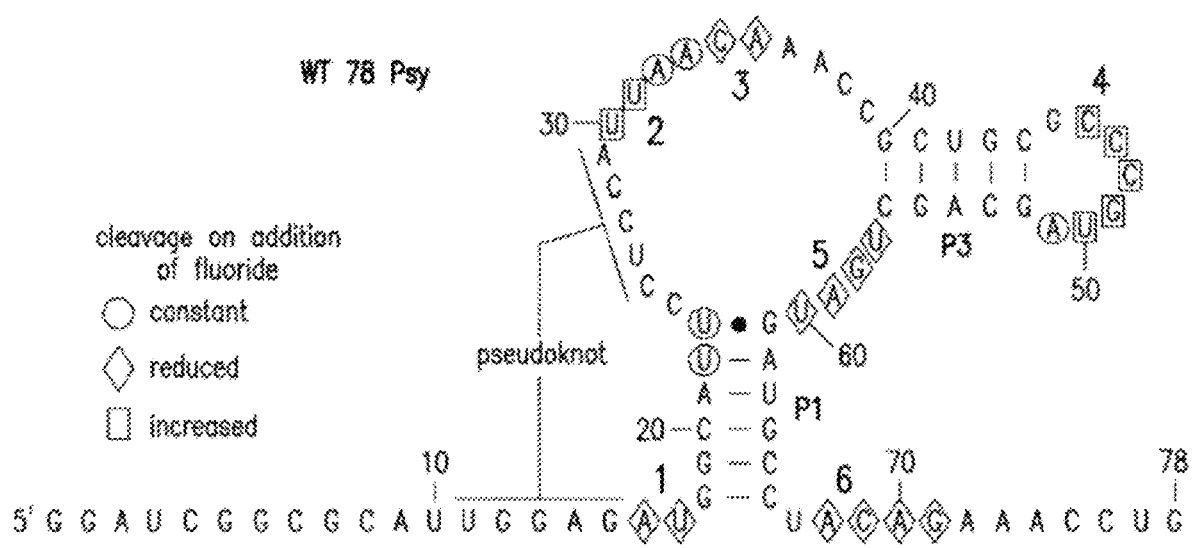
FIG. 48B is FIG. 1B of U.S. Pat. No. 9,580,713 and, as indicated in U.S. Pat. No. 9,580,713 shows the "[s]equence and secondary structure model for the WT 78 Psy RNA (SEQ ID NO:349). Numbers 1, 2, 3, 4, 5, and 6 depict the sites of the in-line probing analysis; results presented in C. The two G residues preceding nucleotide $1_{35}$ were added to facilitate RNA production by in vitro transcription."

An additional exemplary F-sensing riboswitch that is schematically illustrated in FIG. 48B has sequence (SEQ ID NO: 2511)
$G_1G_2A_3U_4C_5G_6G_7C_8G_9C_{10}A_{11}U_{12}U_{13}G_{14}G_{15}A_{16}G_{17}A_{18}U_{19}G_{20}G_{21}C_{22}A_{23}$ $U_{24}U_{25}C_{26}C_{27}U_{28}C_{29}C_{30}A_{31}U_{32}U_{33}A_{34}A_{35}C_{36}A_{37}A_{38}A_{39}C_{40}G_{41}C_{42}U_{43}$ $G_{44}C_{45}G_{46}C_{47}C_{48}C_{49}G_{50}U_{51}A_{52}G_{53}C_{54}A_{55}G_{56}C_{57}U_{58}G_{59}A_{60}U_{61}G_{62}A_{63}$ $U_{64}G_{65}C_{66}C_{67}U_{67}A_{68}C_{69}A_{70}G_{71}A_{72}A_{73}A_{74}C_{75}C_{76}U_{77}G_{78}$ wherein anyone of $_2U_{13}G_{14}G_{15}A_{16}G_{17}$ is linked with any one of $C_{27}U_{28}C_{29}C_{30}A$ by a pseudoknot and the F-sensing riboswitch Additional exemplary sequences are indicated in U.S. Pat. No. 9,580,713. In particular as indicated in U.S. Pat. No. 9,580,713 exemplary crcB motifs are described in (WO 2011/088076 and in [108]) also describing related structure and locations in organisms. Comparative genomics reveals 104 candidate structured RNAs from bacteria, archaeal, and their metagenomes as described in WO 2011/088076 and in [108] which are both hereby incorporated by reference in their entirety. In particular, incorporated by reference in its entirety is section 24 of the Additional File 3 of [108], which shows the sequences of numerous crcB motifs, as well as related genes, organisms, alignments, and consensus structures that can be used in connection with the biosensors herein described.

In some embodiments, the crcB RNA motif sequences herein described is a crcB RNA motif of the RF01734 family annotated by Rfam database which includes 2138 crcB RNA motif sequences of this family, their secondary and 3-D structures, and predicted phylogenetic tree for the sequence alignment (see http://rfam.org/family/RF01734 at the date of filing of the present disclosure which is also incorporated herein by reference in its entirety).

Additional consensus sequence and structures for F-sensing riboswitches are identifiable by a skilled person upon reading of the disclosure. In particular, similar to the consensus sequence and structure of FIG. 1A of U.S. Pat. No. 9,580,713, a consensus secondary structure of the crcB RNA motif sequences of the RF01734 family is illustrated in FIG. 48C. 8 out of 10 base pairs shown in FIG. 48C are significant at E-value=0.05.

Figure 48C:
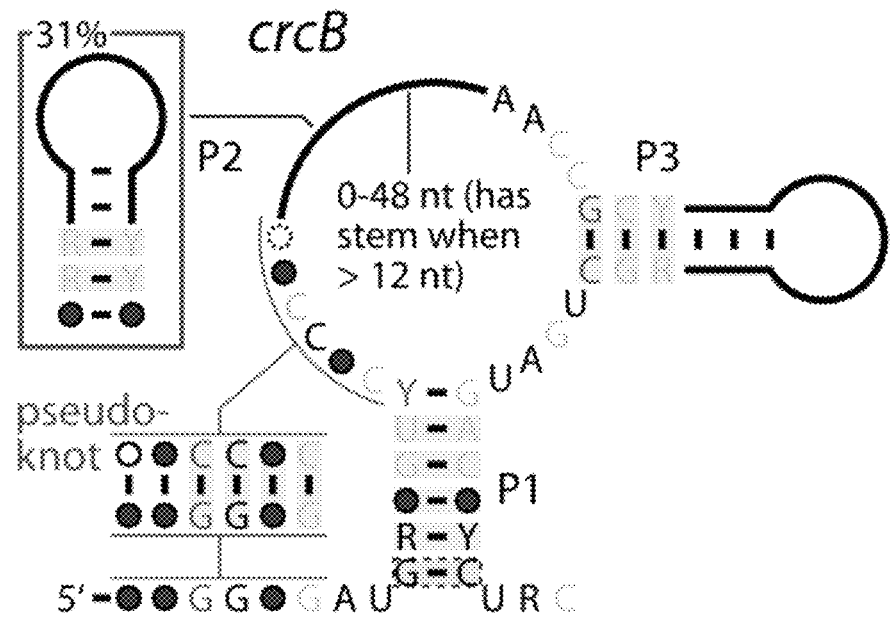
FIG. 48C shows a schematic representation of a consensus secondary structure for F-sensing riboswitches in the sense of the disclosure from https://rfam.org/family/RF01734#tabview=tab0

An F-sensing riboswitch with a consensus sequence and structure schematically illustrated in FIG. 48C has sequence (SEQ ID NO: 2512)
$N_1N_2G_3G_4N_5G_6A_7U_8G_9R_{10}N_{11}G_{12}U_{13}Y_{14}C_{15}N_{16}C_{16}C_{17}N_{18}N_{19}A_{20}A_{21}C_{22}$ $C_{23}G_{24}C_{25}Y_{26}R_{27}G_{28}C_{25}U_{26}G_{27}A_{28}U_{29}G_{30}A_{231}C_{32}N_{33}Y_{34}C_{35}U_{36}R_{37}C_{38}$ wherein
  $N_1\ N_2\ N_5\ N_{11}\ N_{15}\ N_{18}\ N_{19}$ and $N_{37}$ are independently any amino acid;
  $N_1\ N_2\ N_5\ N_{11}\ N_{15}\ N_{18}\ N_{19}$ and $N_{37}$ are independently present or absent;
  anyone of $N_1N_2G_3G_4N_5G_6A_7$ can be linked with any one of $C_{15}N_{16}C_{16}C_{17}N_{18}N_{19}$ by a pseudoknot of sequence NNCCNC
  a first insertion segment of 0 to 48 nucleotides is located between $N_{19}$ and $A_{20}$, wherein when the first insertion segment is >12 nucleotides long, the first insertion comprises a stem loop structure of variable length having sequence starting with NRR and ending with YYN in a 5' to 3' direction
  a second insertion segment of variable length structure is located between $Y_{26}$ and $R_{26}$, the second insertion segment configured to form a stem loop;
  R is A or G; and
  Y is C or U,
as also indicated in FIG. 48C.

In F-sensing riboswitches of sequence SEQ ID NO: 2512, any one of $N_1\ N_2\ N_5\ N_{11}\ N_{15}\ N_{18}$ and $N_{37}$ is a 97% conserved nucleotide (present in 97% of the F-sensing riboswitches encompassed by sequence SEQ ID NO: 2512), and $N_{19}$ is a 50% conserved nucleotide (present in 50% of the riboswitches encompassed by sequence SEQ ID NO: 2512) (FIG. 48C)

In particular, exemplary F-sensing riboswitch sequence in the sense of the disclosure can have sequence (SEQ ID NO: 2513)
$N_1\ N_2\ N_3\ N_4\ N_5\ N_6\ N_7\ N_8\ N_9\ G_{10}\ G_{11}\ N_{12}\ G_{13}\ A_{14}\ U_{15}\ G_{16}\ G_{17}$ $N_{18}\ G_{19}\ U_{20}\ Y_{21}\ C_{22}\ N_{23}\ C_{24}\ C_{25}\ N_{26}\ N_{27}\ N_{28}\ A_{29}\ A_{30}\ C_{31}\ C_{32}$ $G_{33}\ C_{34}\ Y_{35}\ N_{36}\ N_{37}\ N_{38}\ N_{39}\ N_{40}\ N_{41}\ N_{42}\ R_{43}\ G_{44}\ C_{45}\ U_{46}\ G_{47}$ $A_{48}\ U_{49}\ G_{50}\ A_{51}\ C_{52}\ N_{53}\ Y_{54}\ C_{55}\ U_{56}\ R_{57}\ C_{58}\ N_{59}\ N_{60}\ N_{61}\ N_{62}$ $N_{63}\ N_{64}$ wherein
  $N_1$, $N_2$, $N_3$, $N_4$, $N_5$, $N_6$, $N_7$, $N_8$, $N_9$, $N_{12}$, $N_{18}$, $N_{23}$, $N_{26}$, $N_{27}$, $N_{28}$, $N_{36}$, $N_{37}$, $N_{38}$, $N_{39}$, $N_{40}$, $N_{41}$, $N_{42}$, $N_{53}$, $N_{59}$, $N_{60}$, $N_{61}$, $N_{62}$, $N_{63}$, $N_{64}$ are interdependently any amino acid;
  R is A or G; and
  Y is C or U.

Figure 48D:
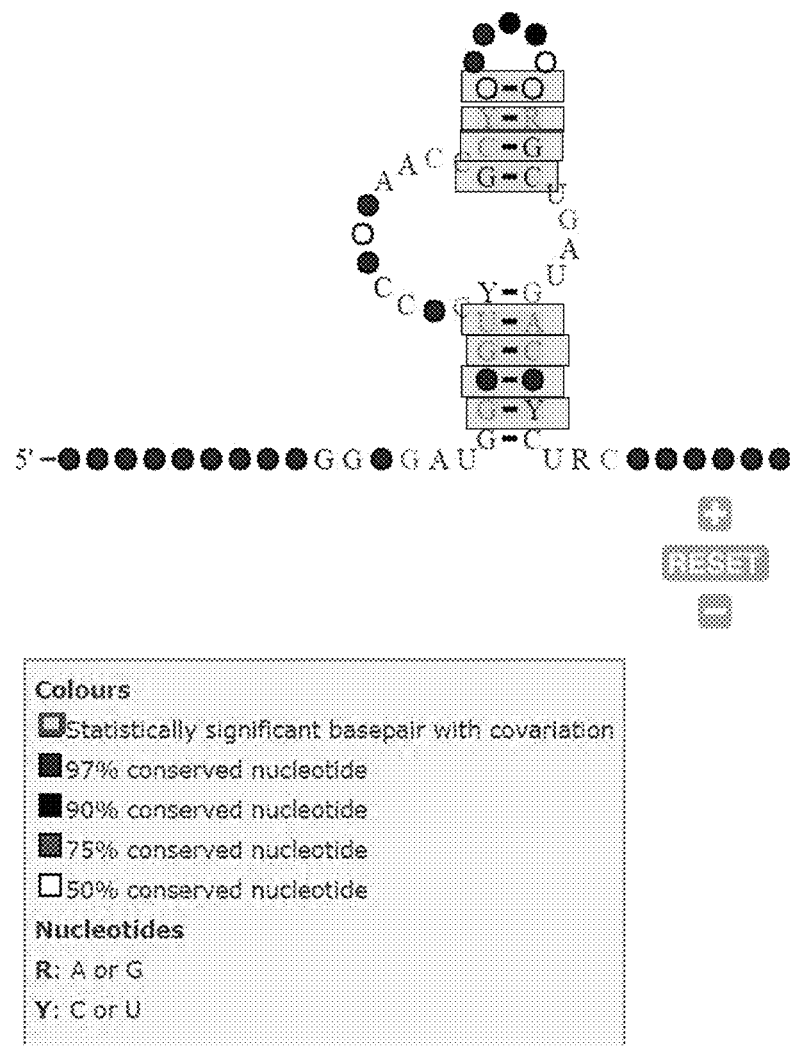
FIG. 48D shows a schematic representation of an exemplary fluoride sensing riboswitch herein described which correspond to a grayscale version of schematic reported in https://rfam.xfam.org/family/RFO 1734#tabview=tab3 at the filing date of the present application.

In particular, in F-sensing riboswitches of sequence SEQ ID NO: 2513,
  each of nucleotides $N_1$, $N_2$, $N_3$, $N_4$, $N_5$, $N_6$, $N_7$, $N_8$, $N_9$, $G_{11}\ N_{12}$, $A_{14}\ U_{15}\ G_{16}$, $N_{18}$, $N_{23}$, $C_{24}$, $N_{26}\ N_{28}$, $A_{29}\ A_{30}$, $N_{37}\ N_{38}\ U_{46}\ A_{48}\ U_{49}\ N_{53}\ Y_{54}\ C_{55}\ U_{56}\ C_{58}\ N_{59}\ N_{60}\ N_{61}\ N_{62}\ N_{63}\ N_{64}$ is a 97% conserved nucleotide (conserved in 97% of the F-sensing riboswitches)
  each of nucleotides $G_{10}$, $Y_{21}$, $C_{25}$, $G_{33}\ N_{39}\ N_{40}\ R_{57}$ is a 90% conserved nucleotide (conserved in 90% of the F-sensing riboswitches)
  each of nucleotides $G_{13}\ G_{17}\ G_{19}\ C_{22}\ U_{20}\ C_{31}\ C_{32}\ C_{34}\ Y_{35}\ R_{43}\ G_{44}\ C_{45}\ G_{47}\ G_{50}\ A_{51}\ C_{52}$ is a 75% conserved nucleotide (conserved in 75% of the F-sensing riboswitches); and
  each of nucleotides $N_{27}\ N_{36}\ N_{41}\ N_{42}$ is a 50% conserved nucleotide (conserved in 50% of the F-sensing riboswitches)
as illustrated in FIG. 48D In particular, F-sensing riboswitches of sequence SEQ ID NO: 2513 and FIG. 48D the positions of the riboswitch $N_1$, $N_2$, $N_3$, $N_4$, $N_5$, $N_6$, $N_7$, $N_8$, $N_9$, $G_{11}\ N_{12}$, $A_{14}\ U_{15}\ G_{16}$, $N_{18}$, $N_{23}$, $C_{24}$, $N_{26}\ N_{28}$, $A_{29}\ A_{30}$, $N_{37}\ N_{38}\ U_{46}\ A_{48}\ U_{49}\ N_{53}\ Y_{54}\ C_{55}\ U_{56}\ C_{58}\ N_{59}\ N_{60}\ N_{61}\ N_{62}\ N_{63}\ N_{64}$ [are at least 97% conserved nucleotides, positions $G_{10}$, $Y_{21}$, $C_{25}$, $G_{33}\ N_{39}\ N_{40}\ R_{57}$ are at least 90% conserved nucleotides, positions $G_{13}\ G_{17}\ G_{19}\ C_{22}\ U_{20}\ C_{31}\ C_{32}\ C_{34}\ Y_{35}\ R_{43}\ G_{44}\ C_{45}\ G_{47}\ G_{50}\ A_{51}\ C_{52}$ are at least 75% conserved nucleotides, and positions $N_{27}\ N_{36}\ N_{41}\ N_{42}$ are at least 50% conserved nucleotides. It has been shown that the most highly conserved nucleotides of the RF01734 family undergo structural change on addition of fluoride, which suggests that these nucleotides help form a ligand-binding aptamer for fluoride [102]. Mutations that alter the aptamer's conserved substructures or conserved nucleotides adversely affect fluoride binding, suggesting that the features common to all crcB motif RNAs are necessary for the selective recognition of fluoride.

In some embodiments, the crcB RNA motif of the RF01734 family can have a dissociation constant ($K_D$) of ~60 μM with respect to binding of fluoride. [102]

Exemplary F-sensing riboswitches in the sense of the disclosure also comprise a fluoride sensing riboswitch that can be found in regulatory regions of a fluoride efflux pump called Eric$^F$, a F$^-$/H$^+$ antiporter), performing an function (F$^-$ efflux) of CrcB efflux pump. that is commonly associated with fluoride riboswitches. CrcB and Eric$^F$ are expected to carryout the same function—fluoride export. It seems that organisms have one or the other.

Figure 53:
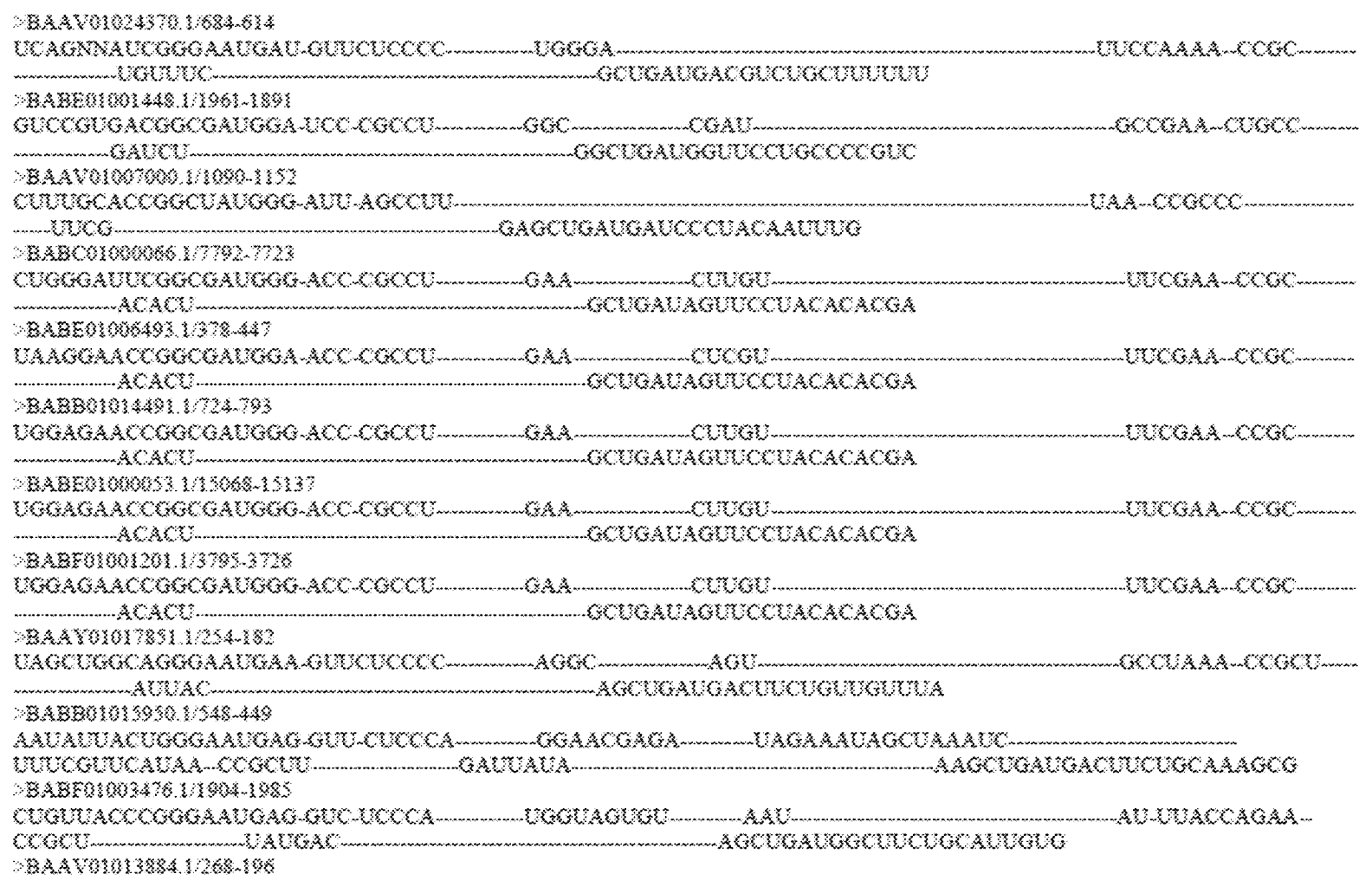
Figure 53:
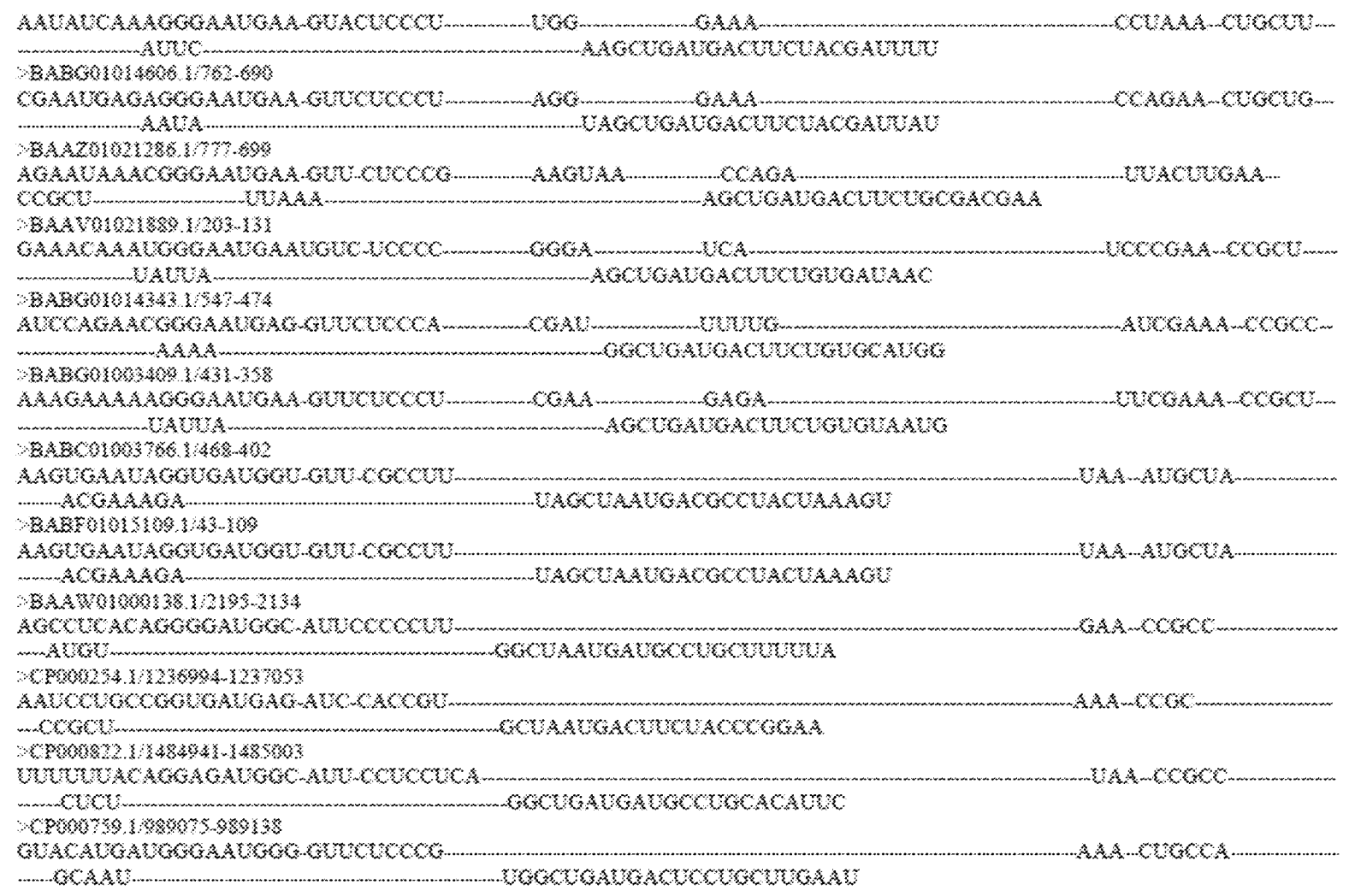
Figure 53:
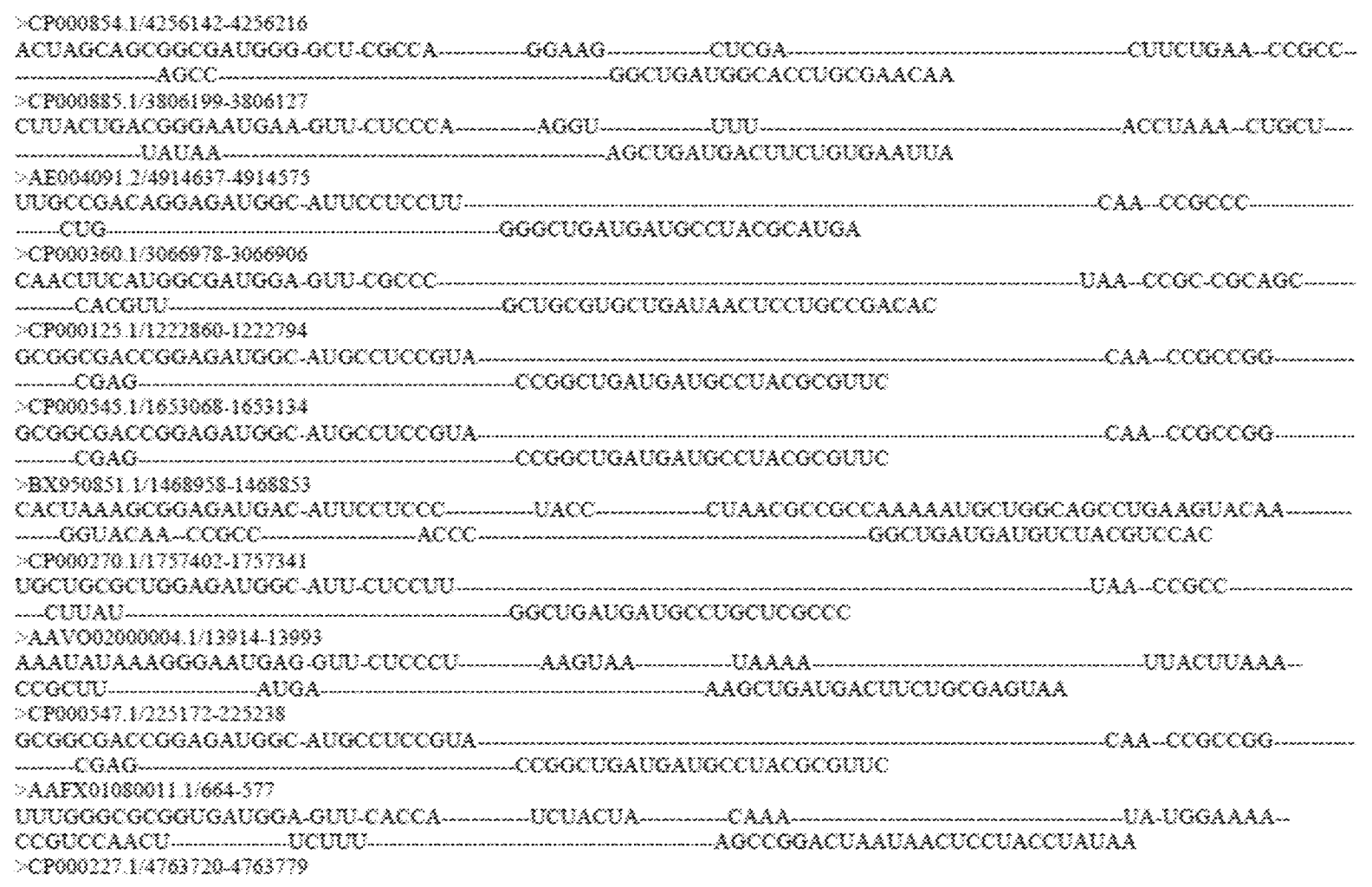
Figure 53:
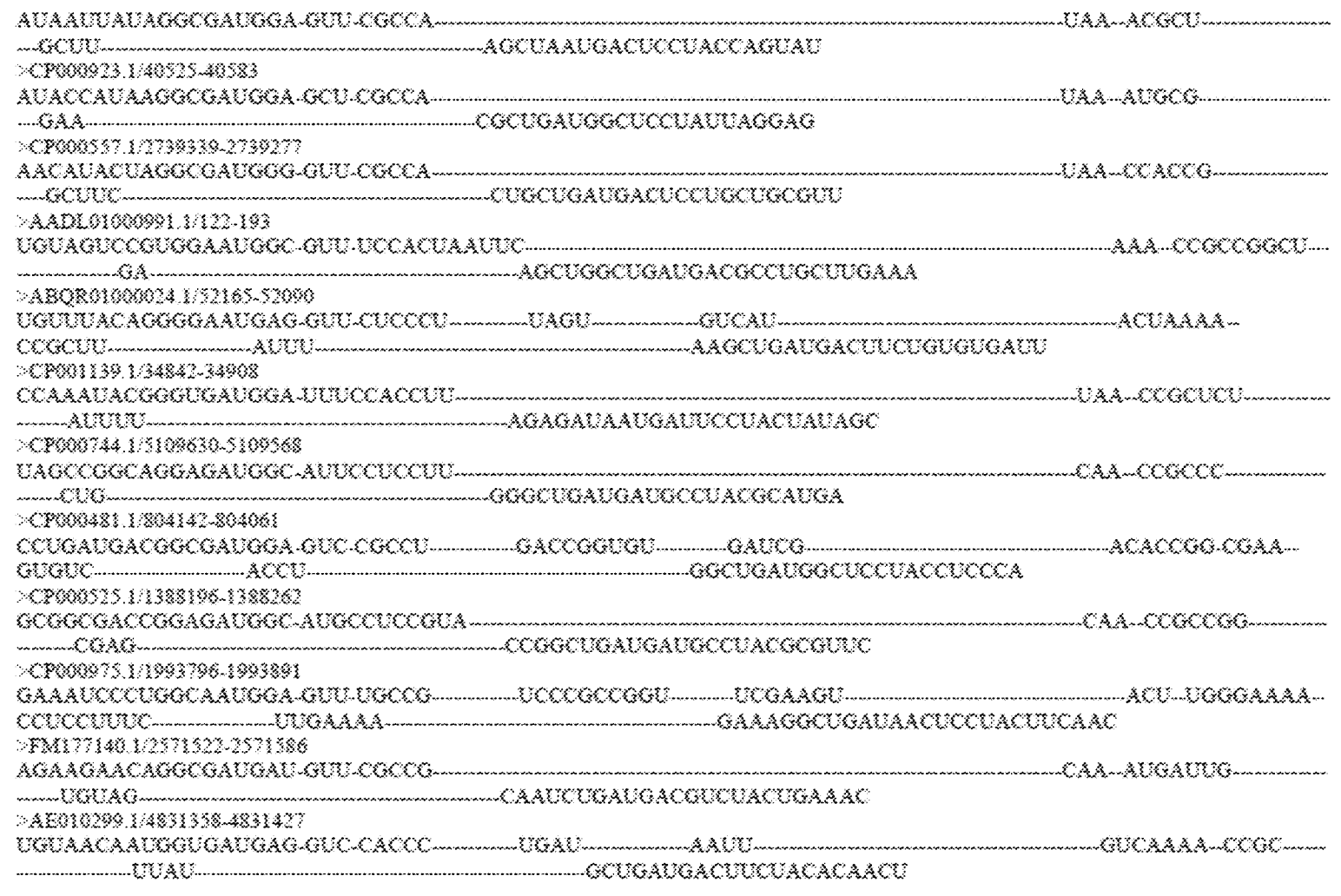
Figure 53:
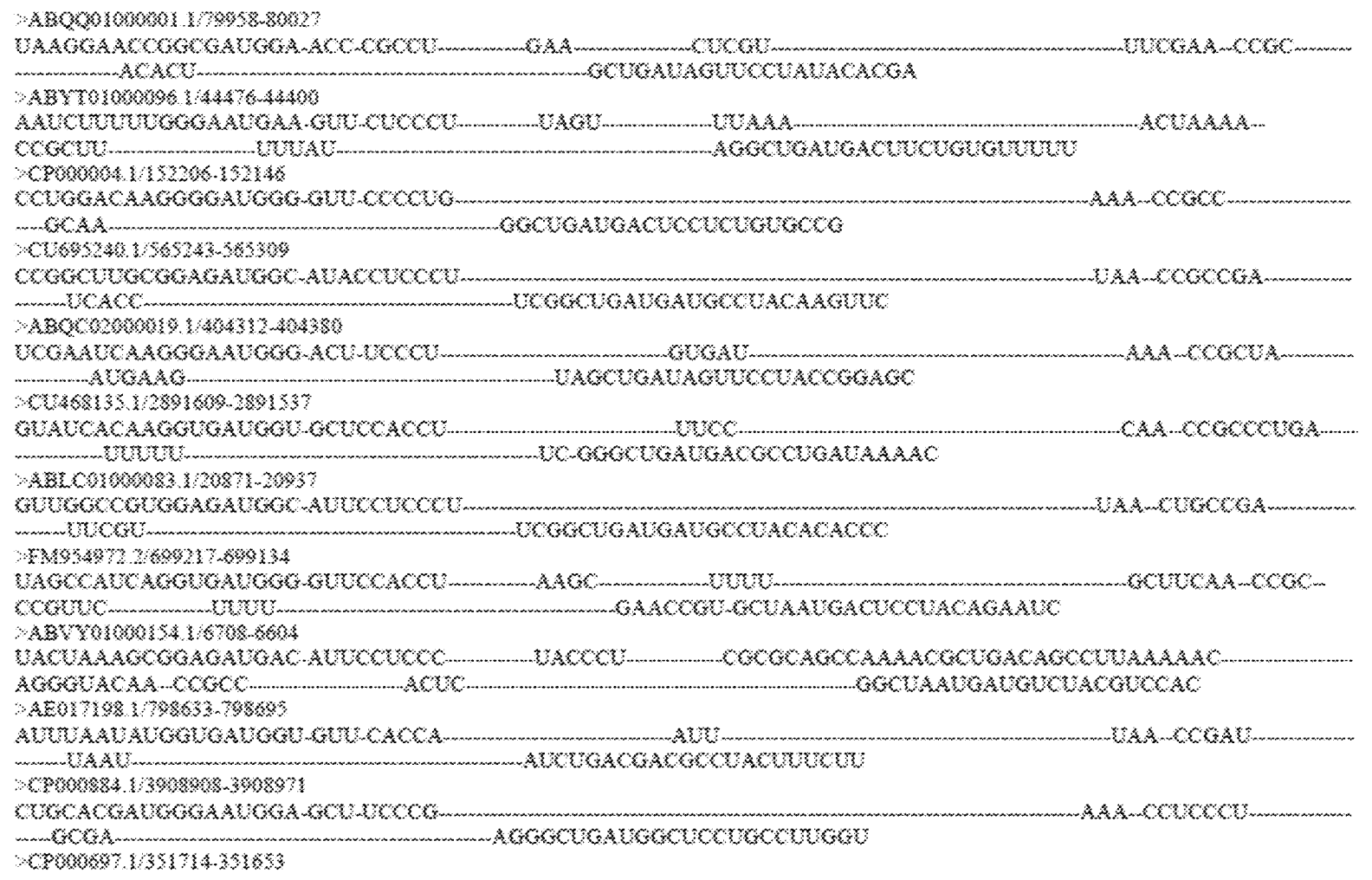
Figure 53:
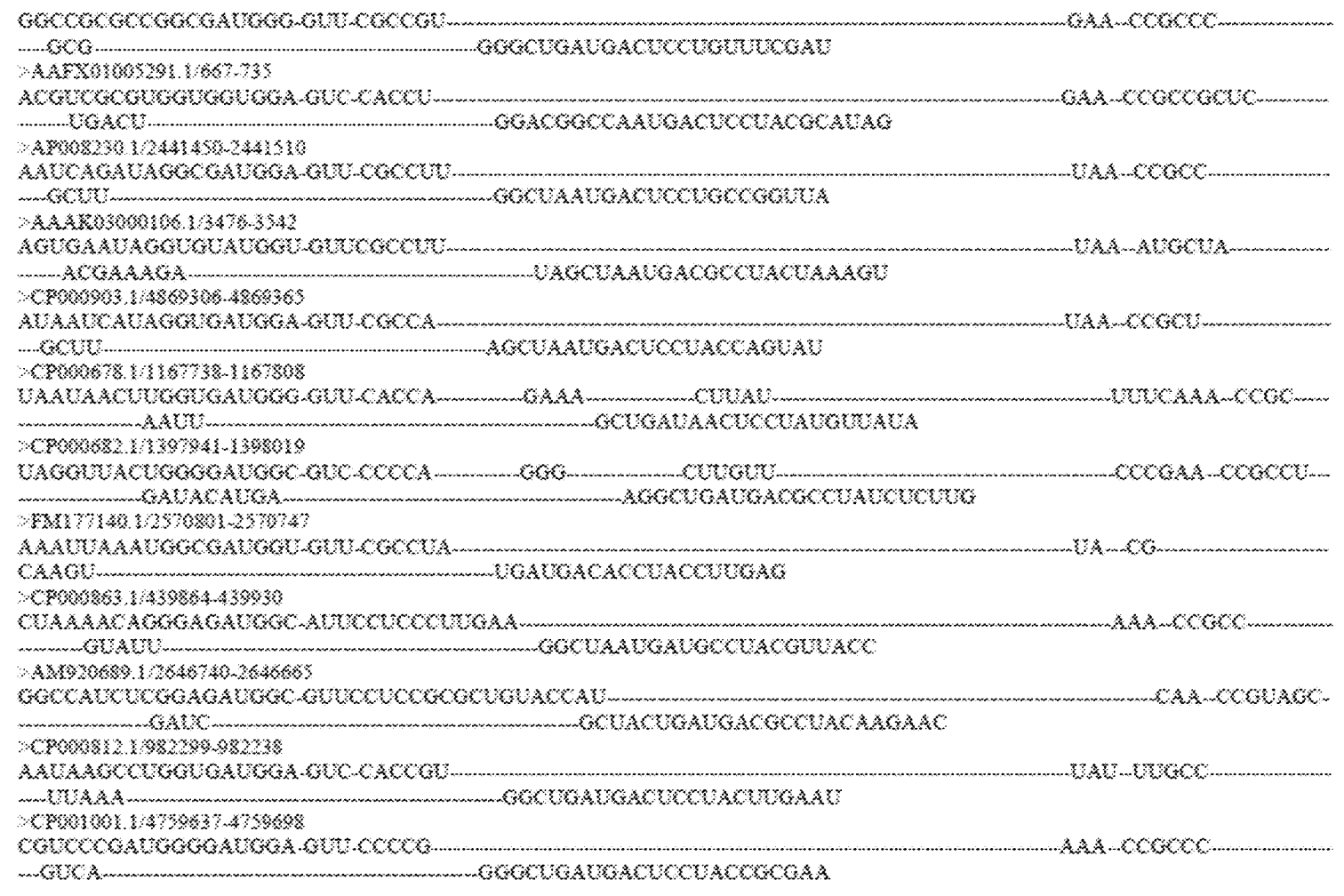
Figure 53:
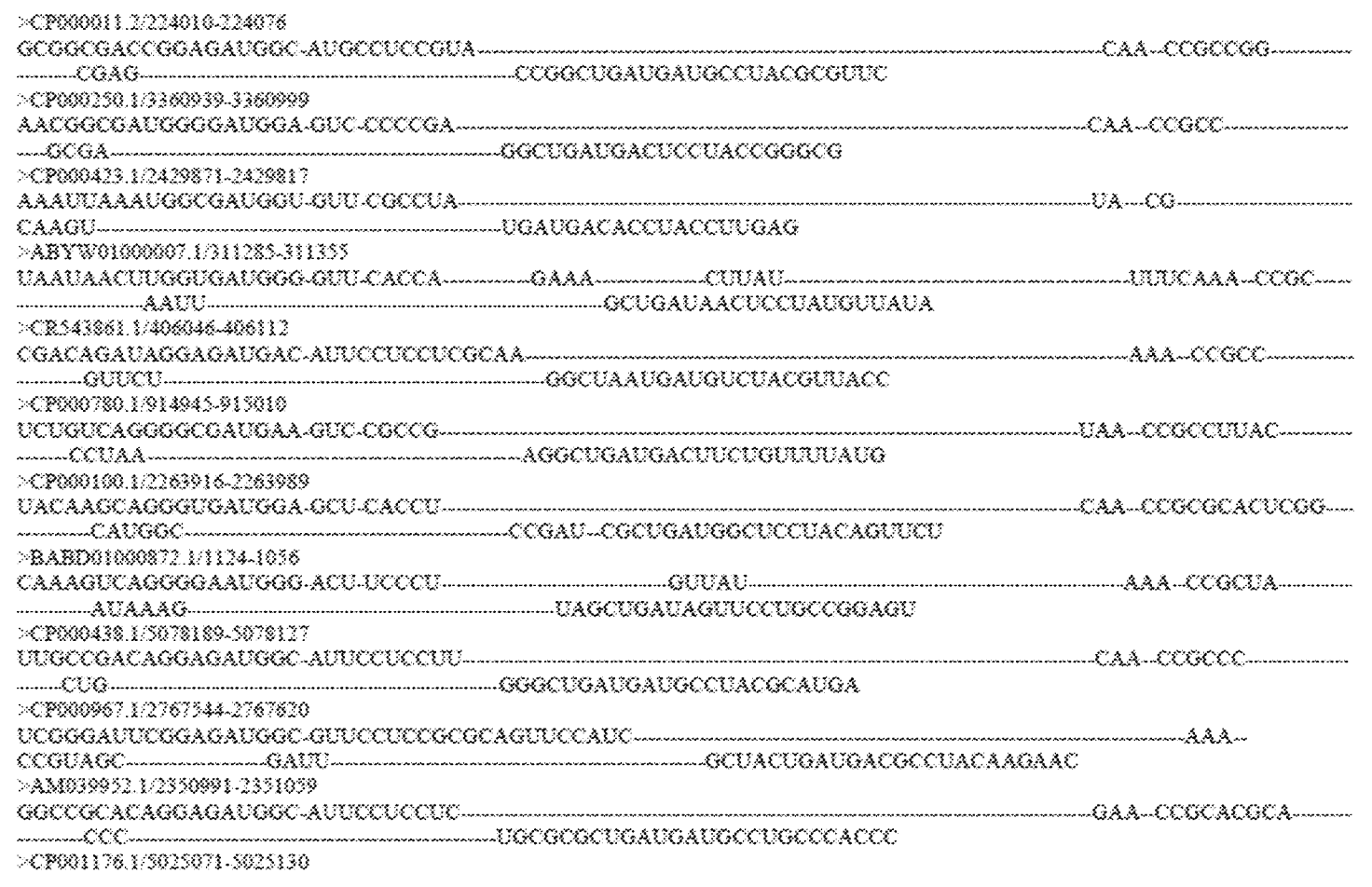
Figure 53:
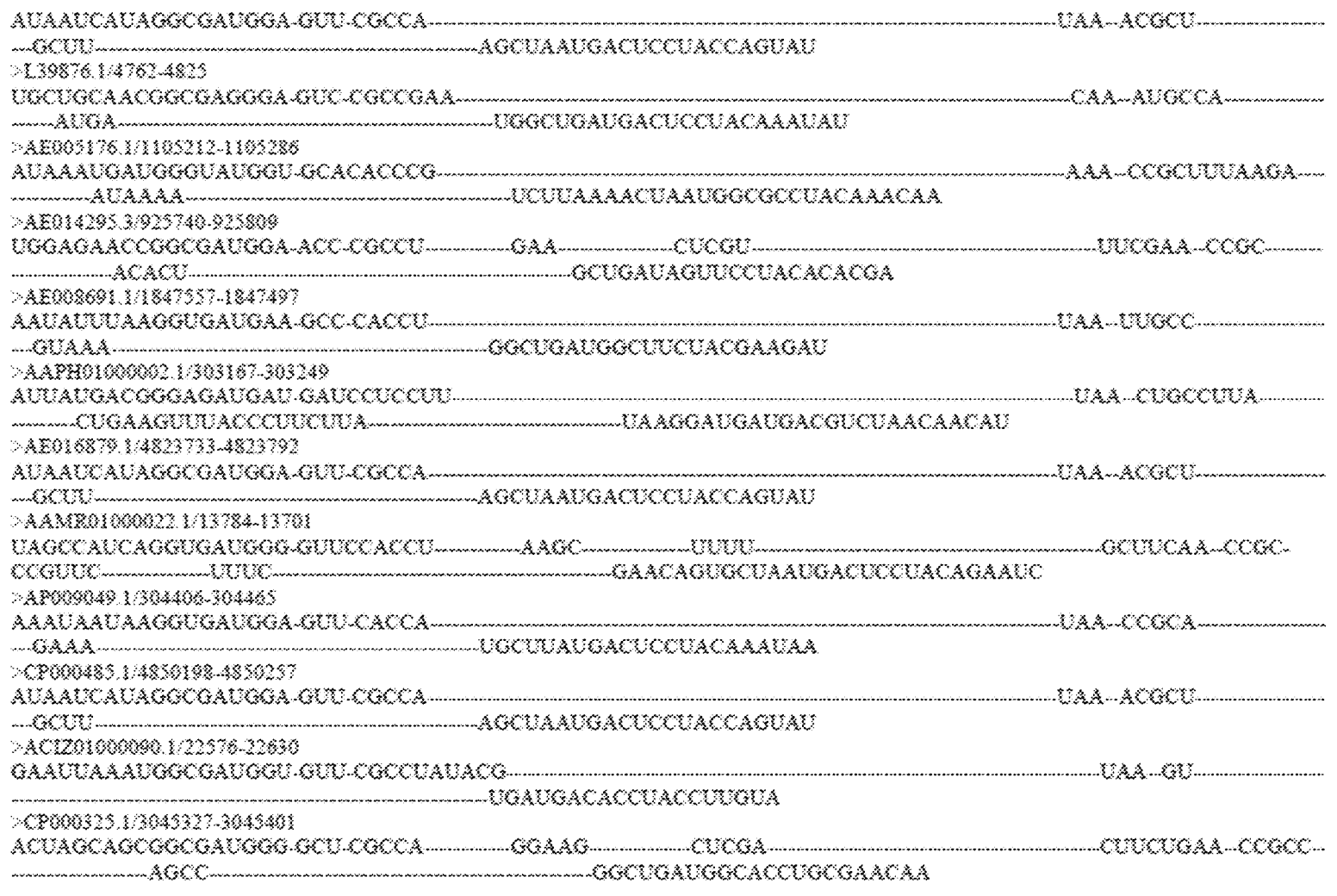
Figure 53:
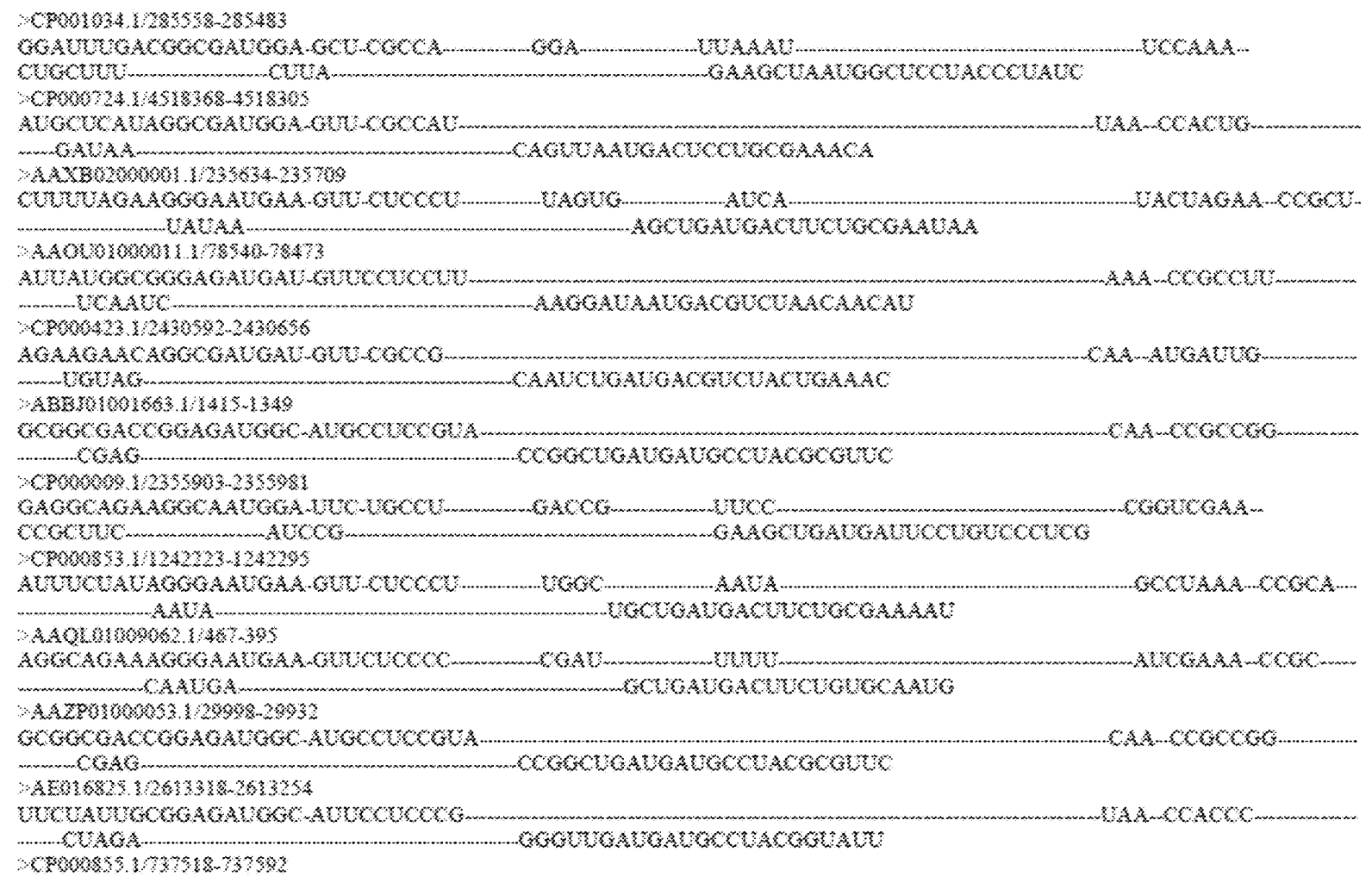
Figure 53:
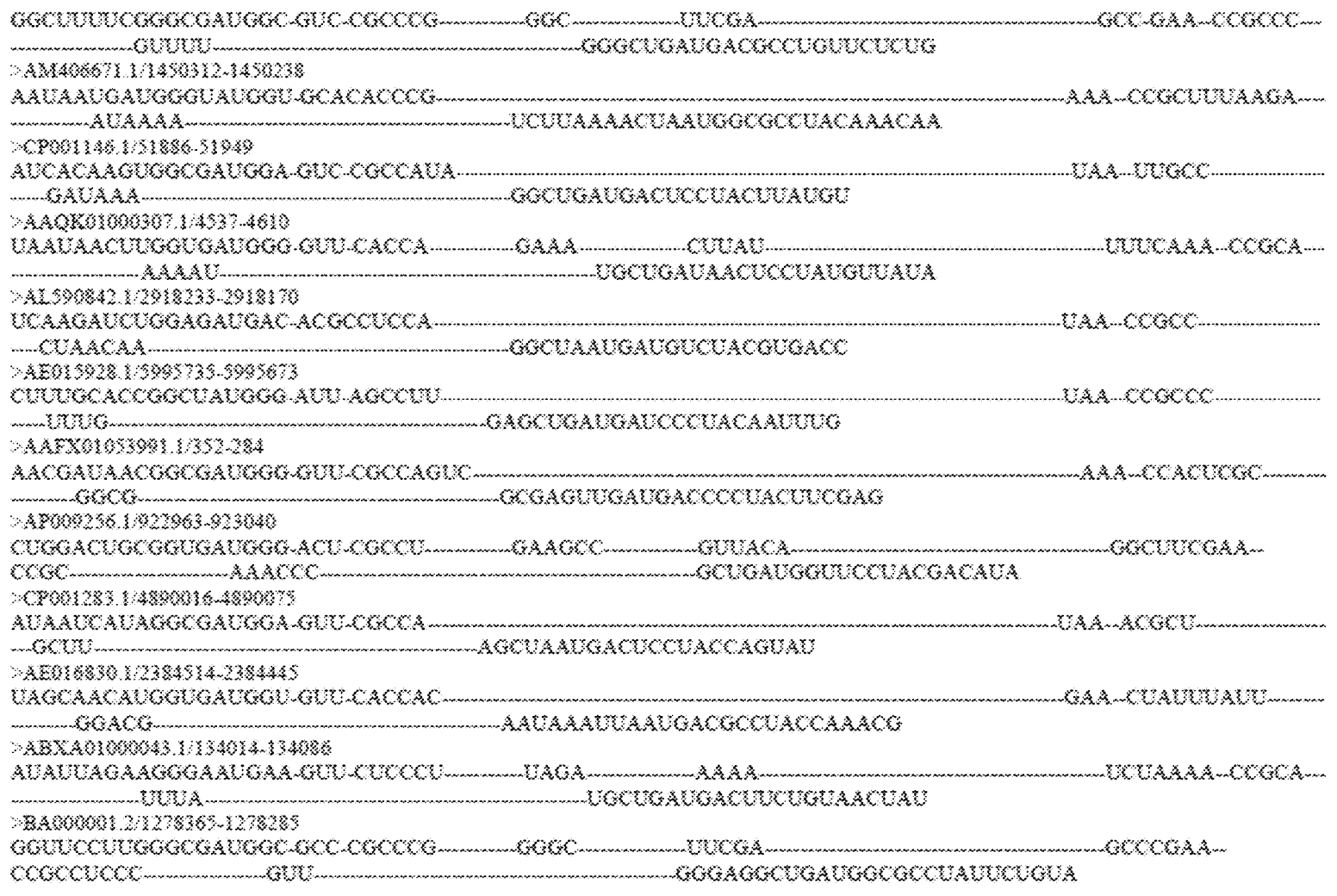
Figure 53:
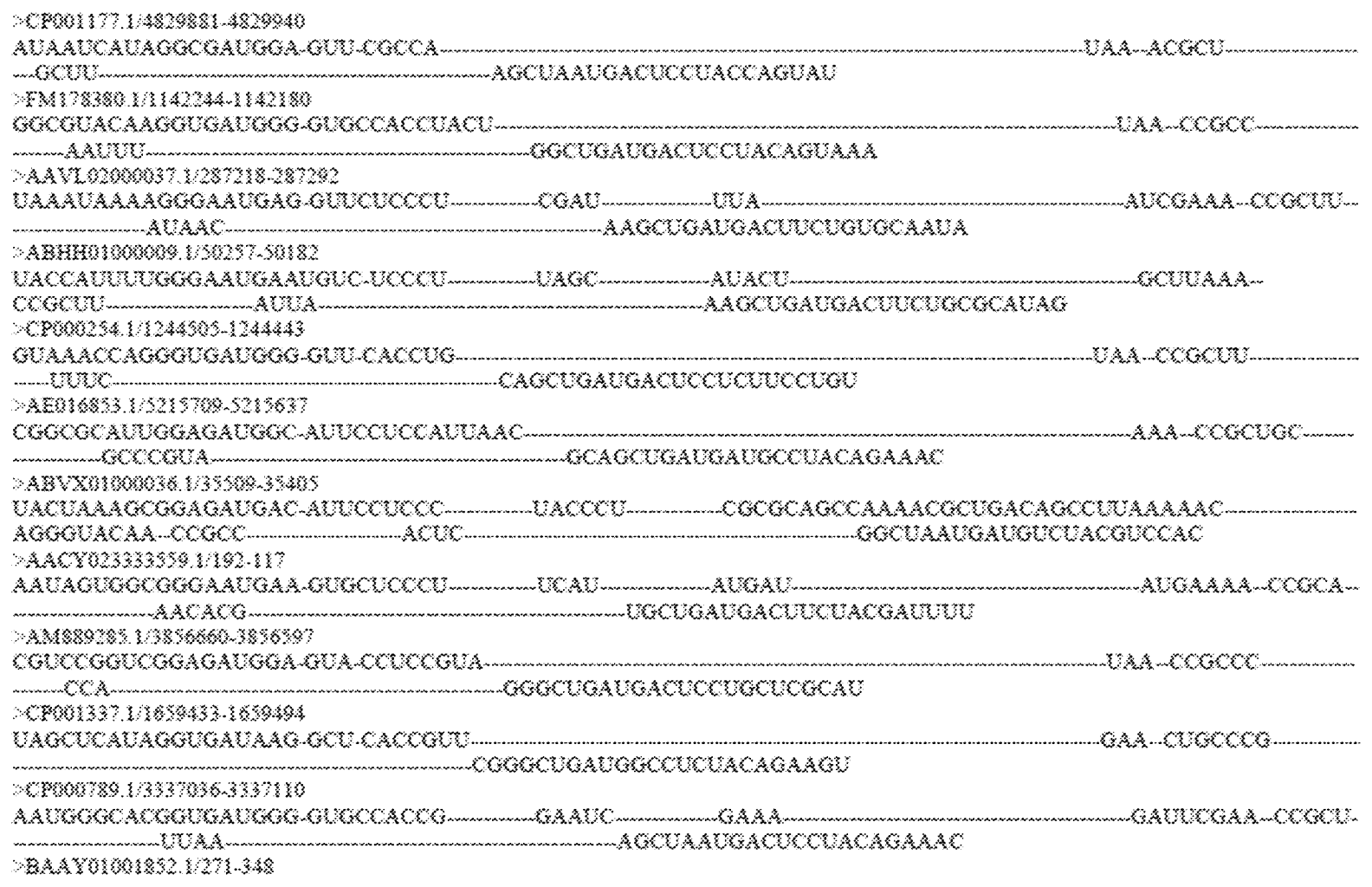
Figure 53:
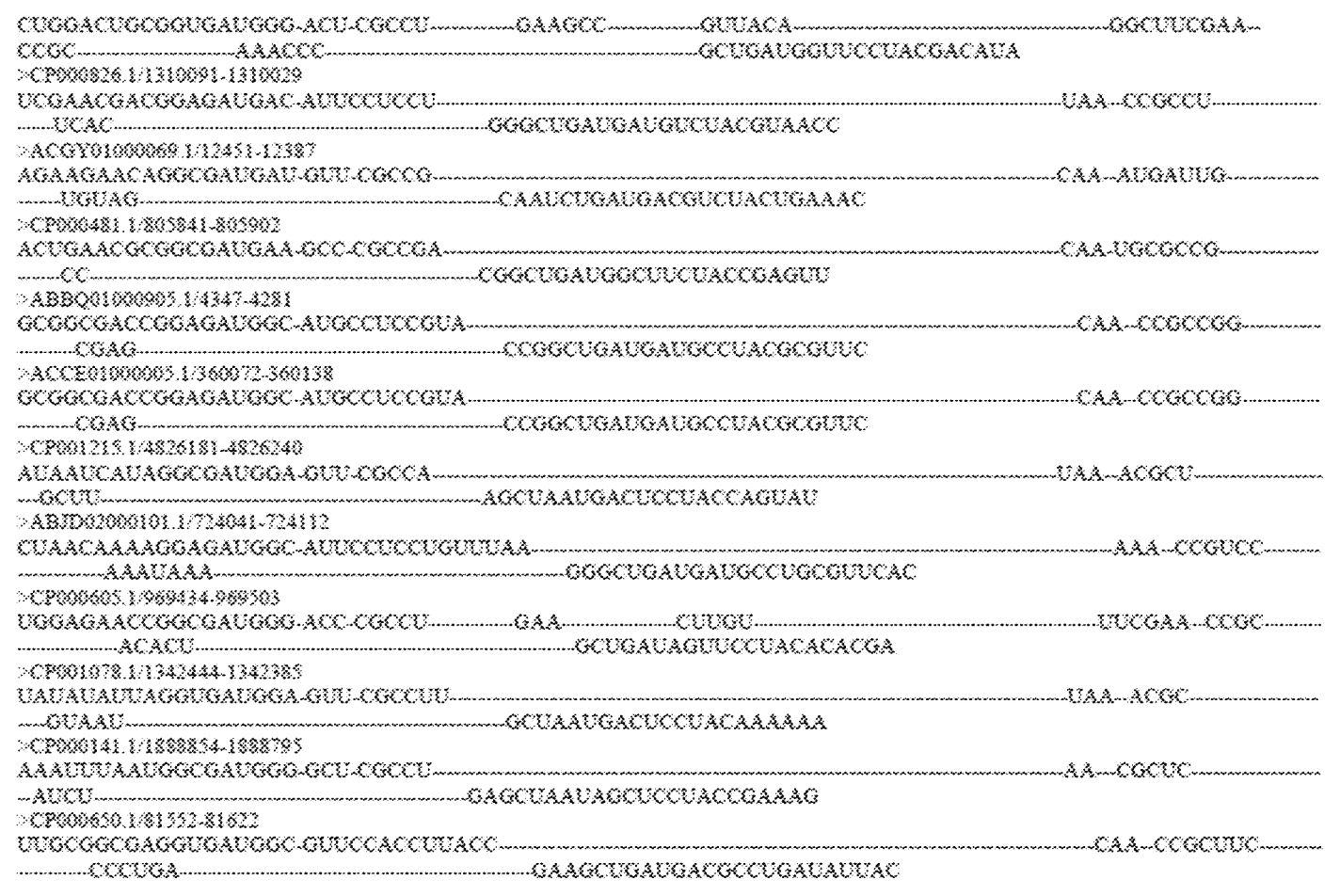
Figure 53:
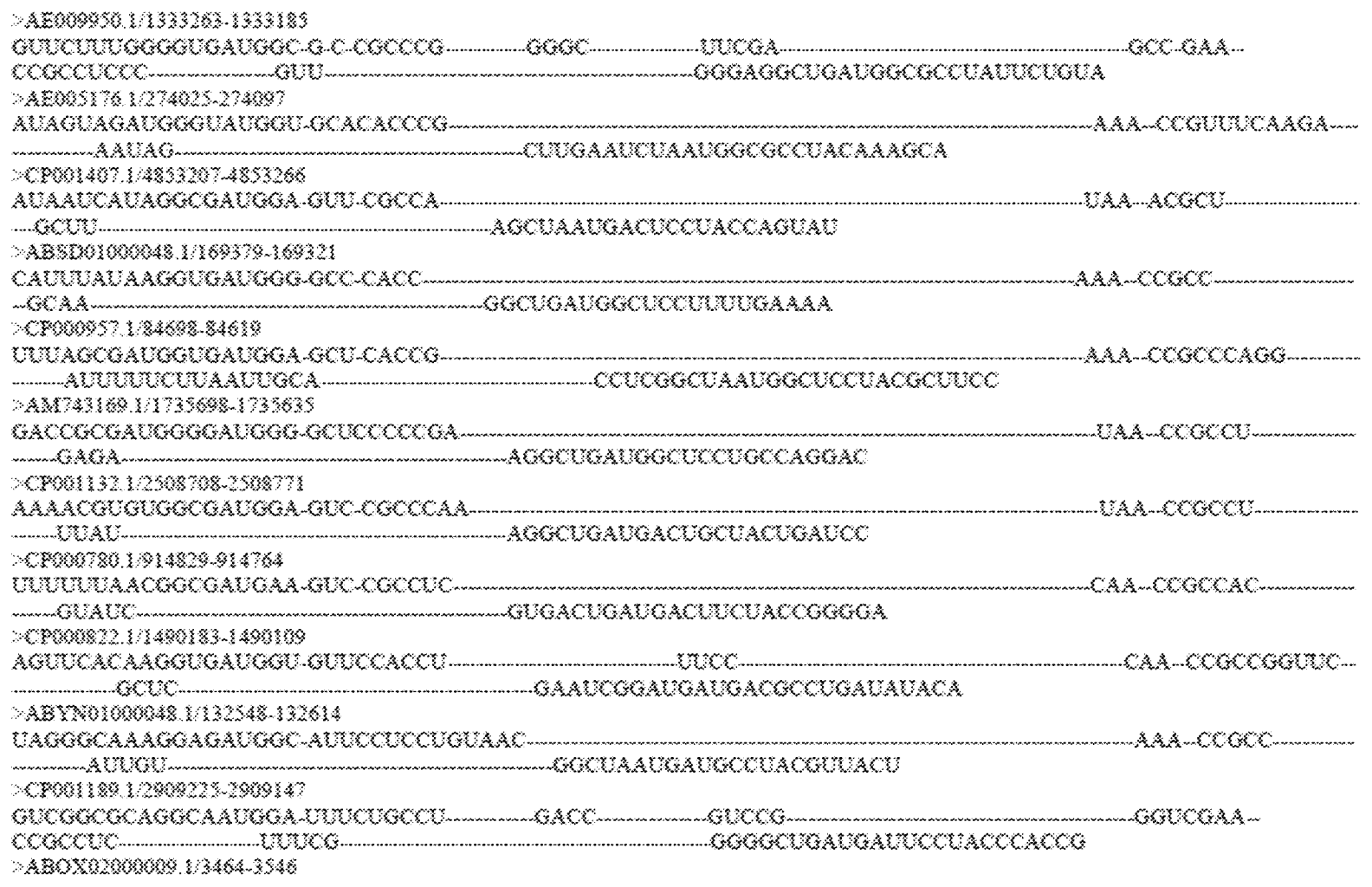
Figure 53:
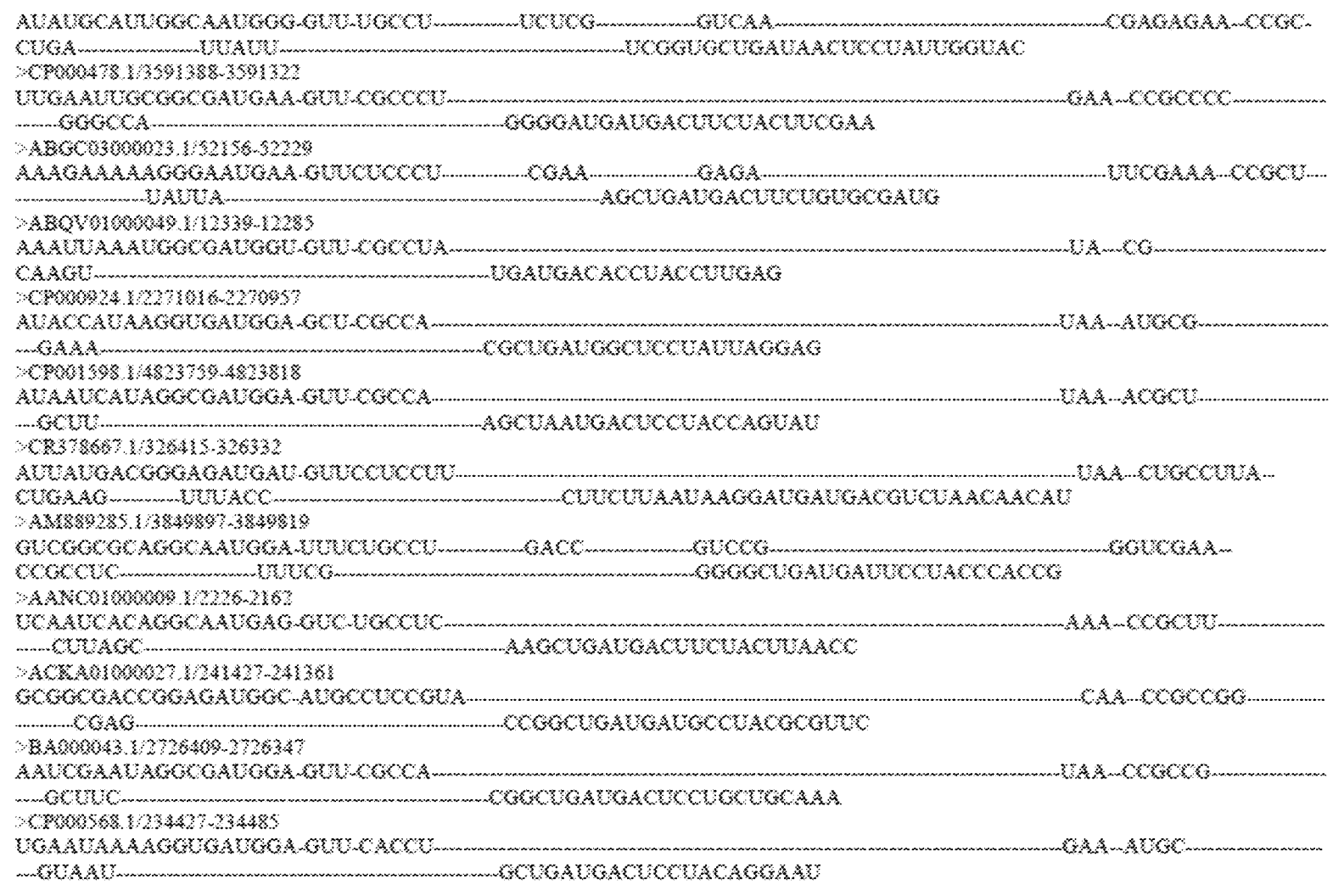
Figure 53:
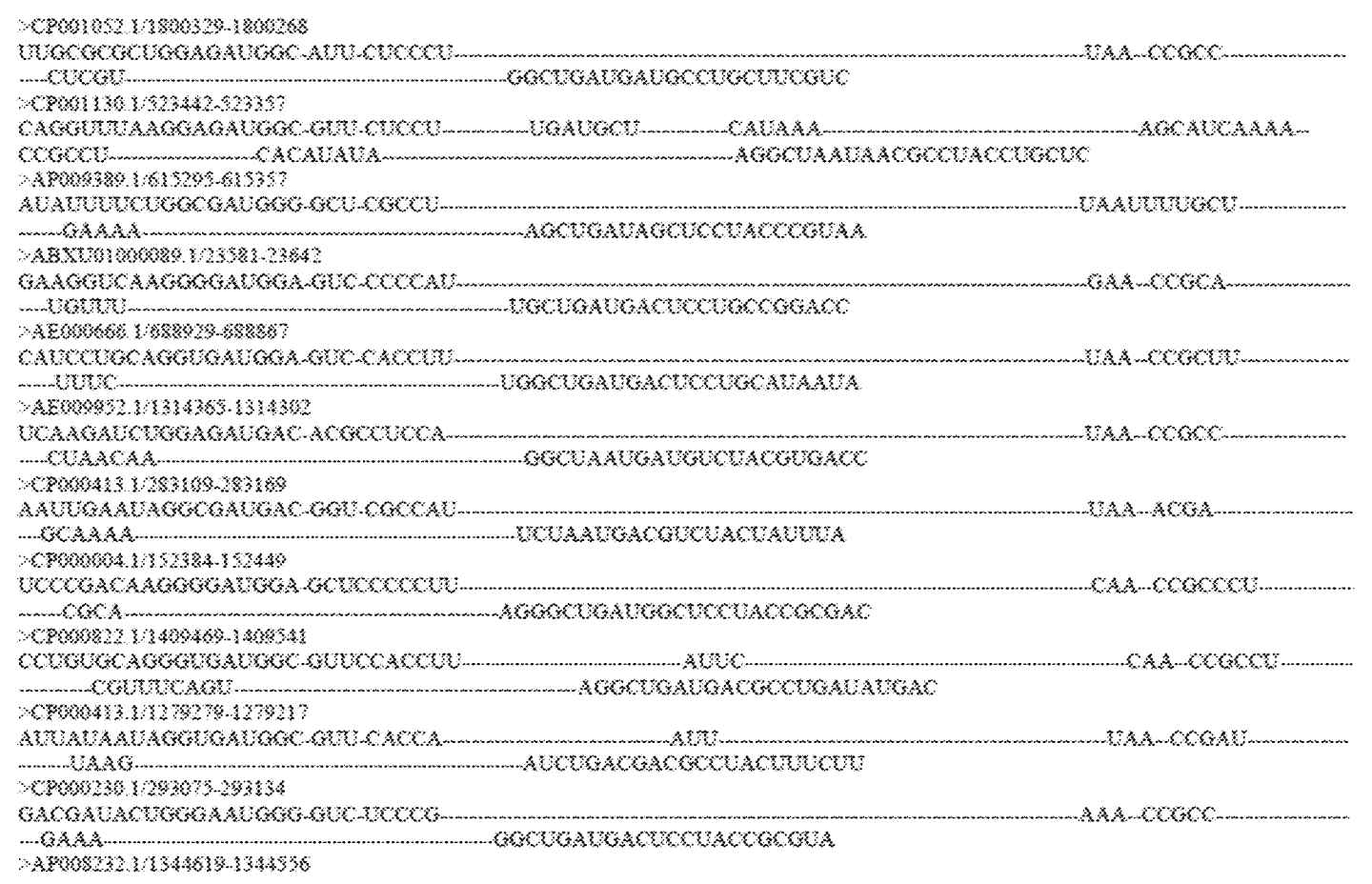
Figure 53:
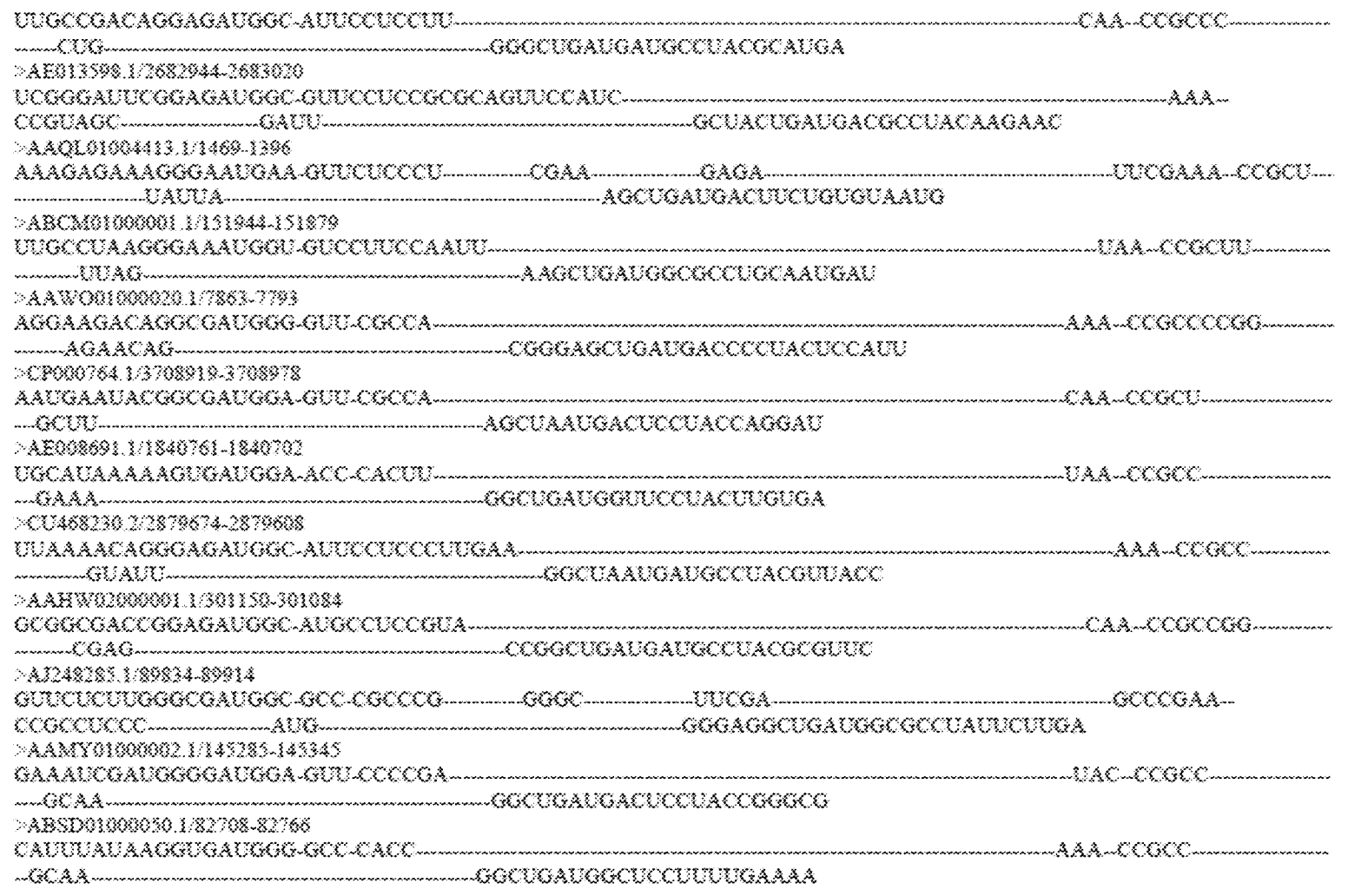
Figure 53:
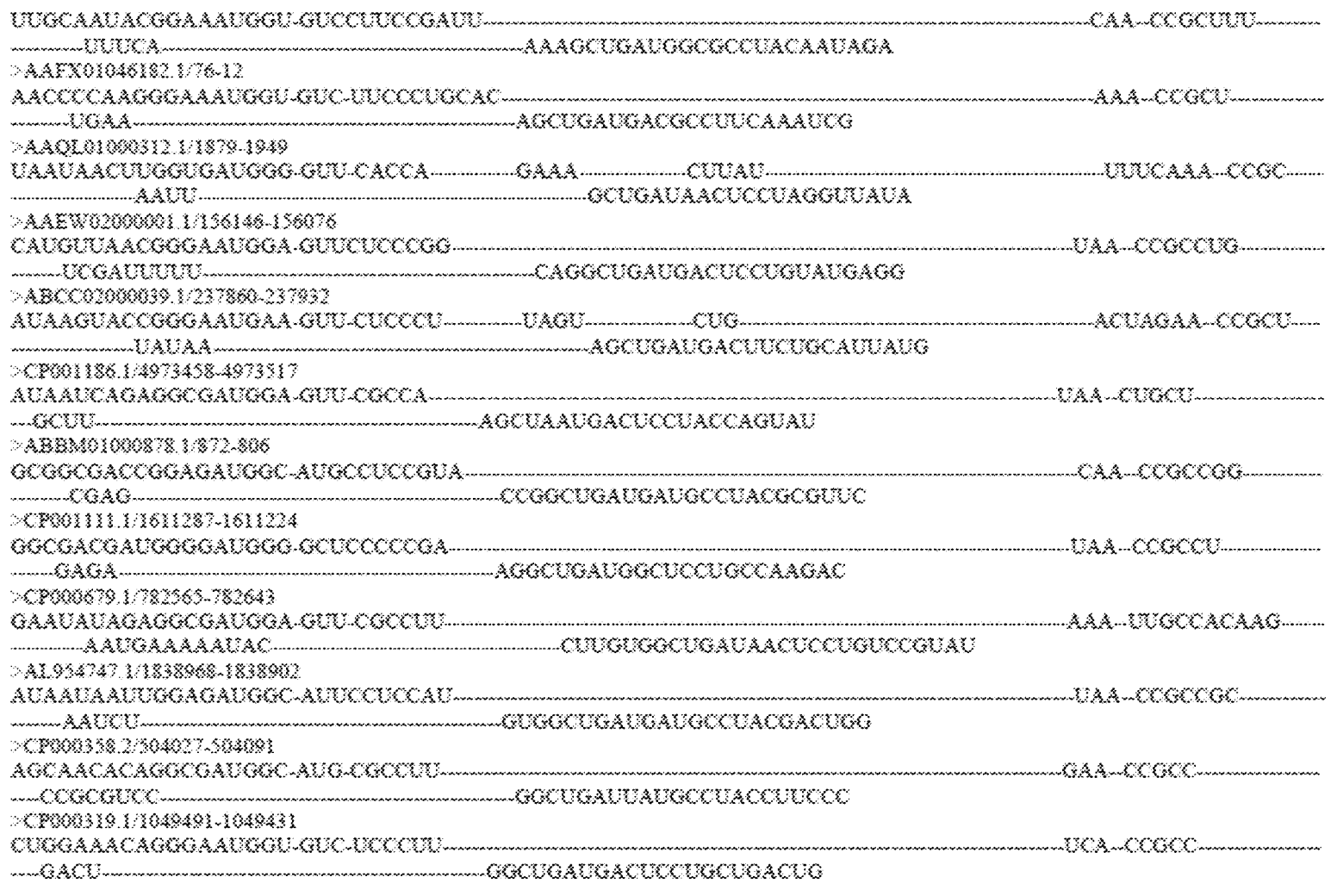
Figure 53:
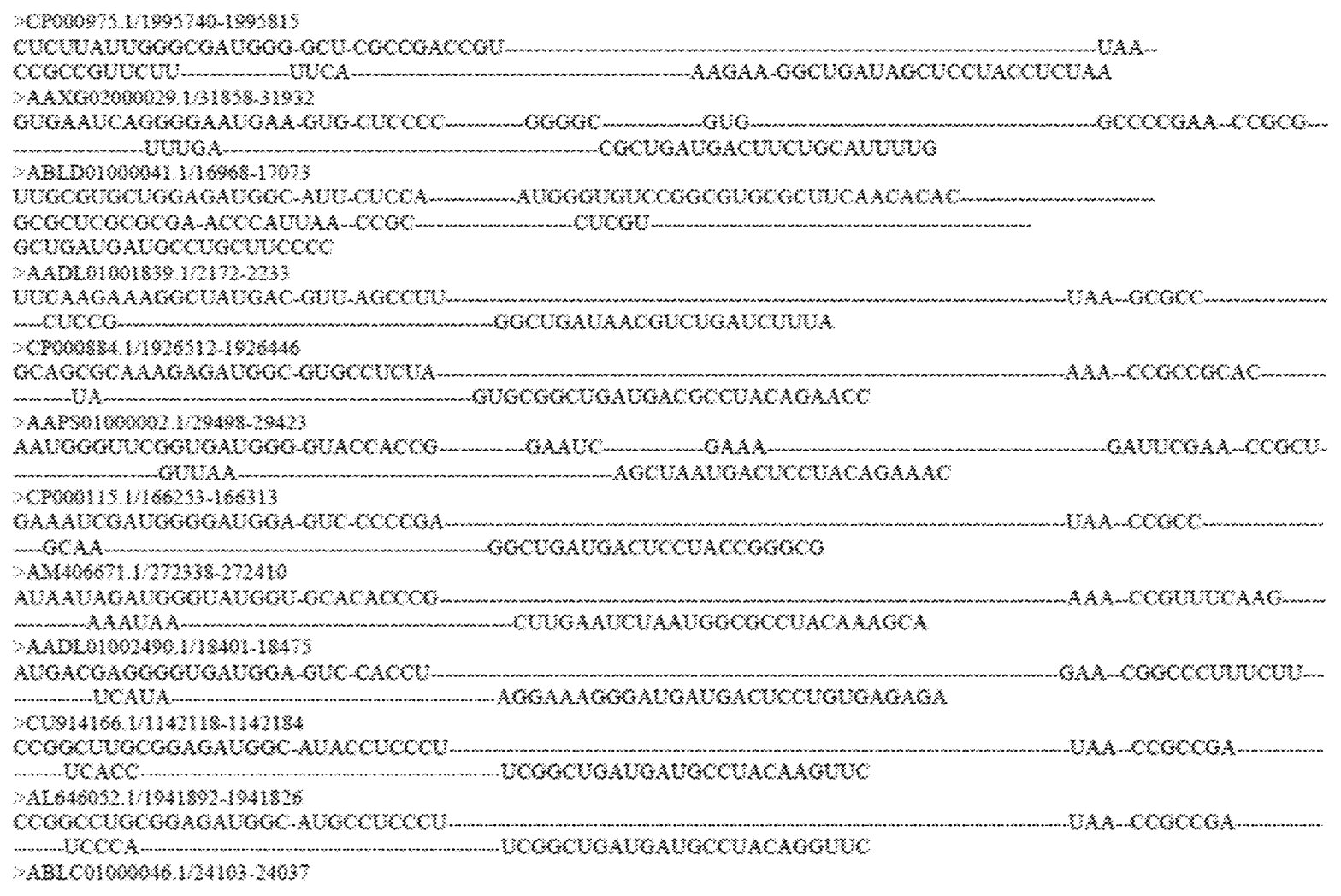
Figure 53:
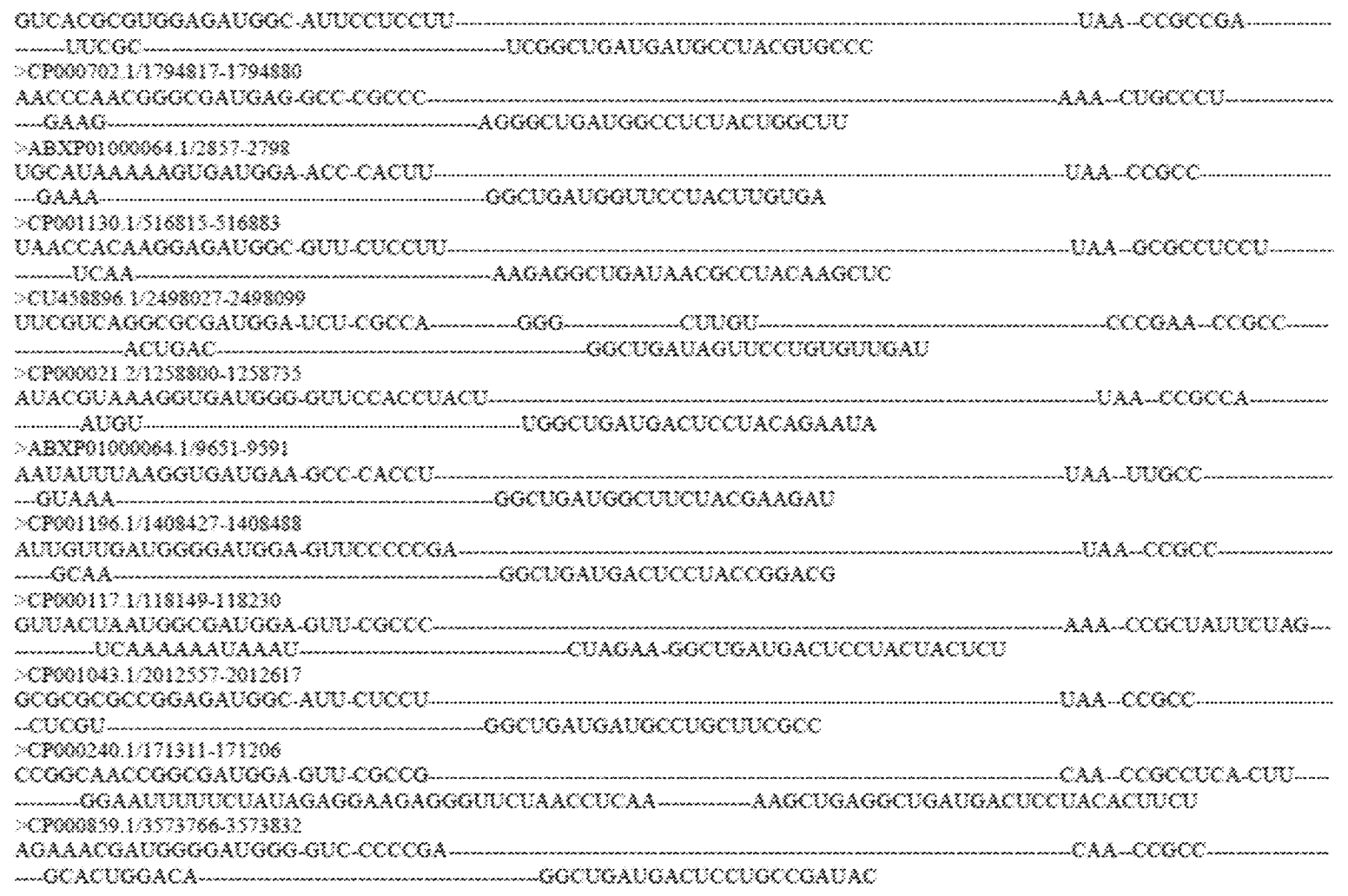
Figure 53:
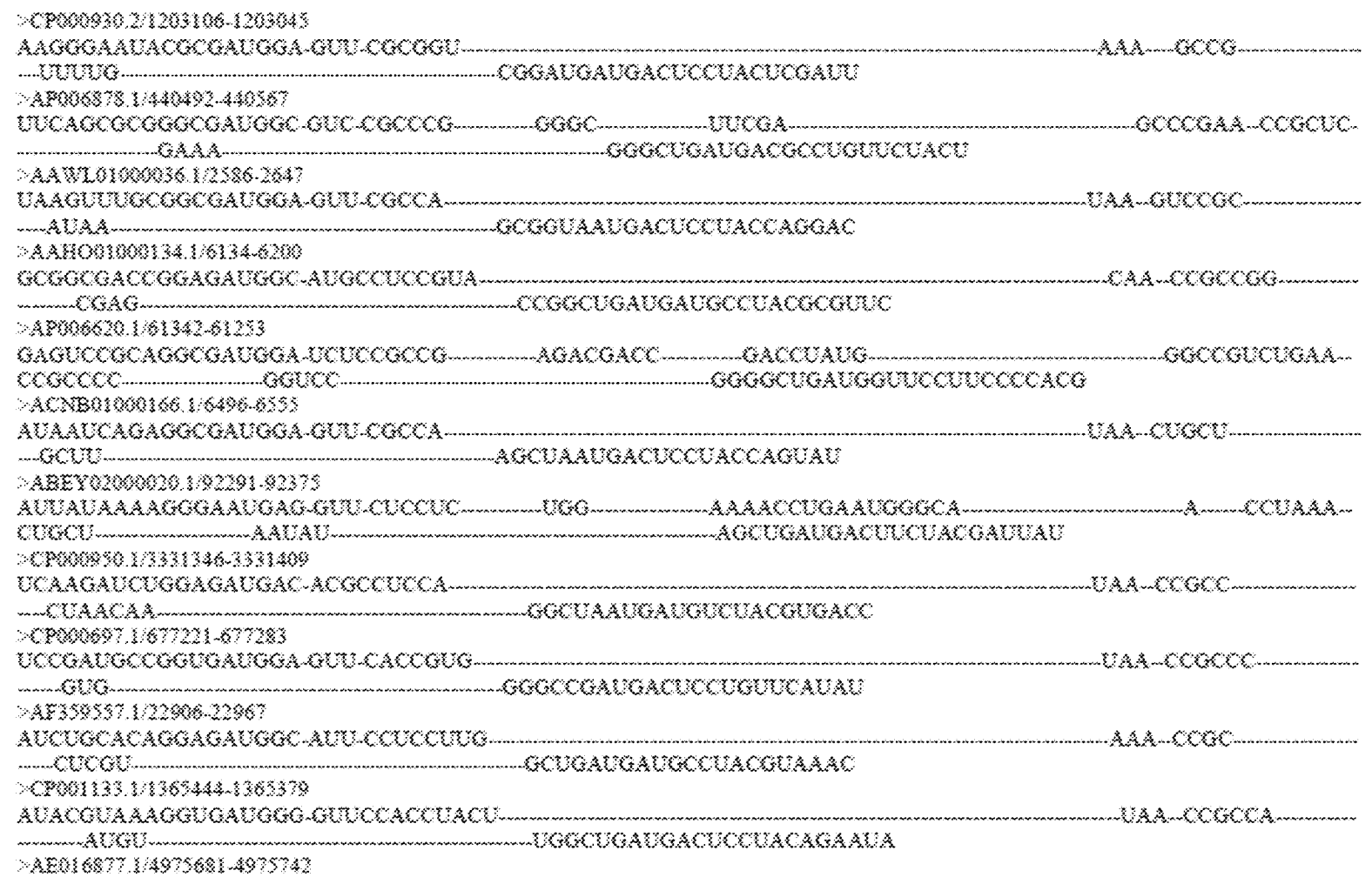
Figure 53:
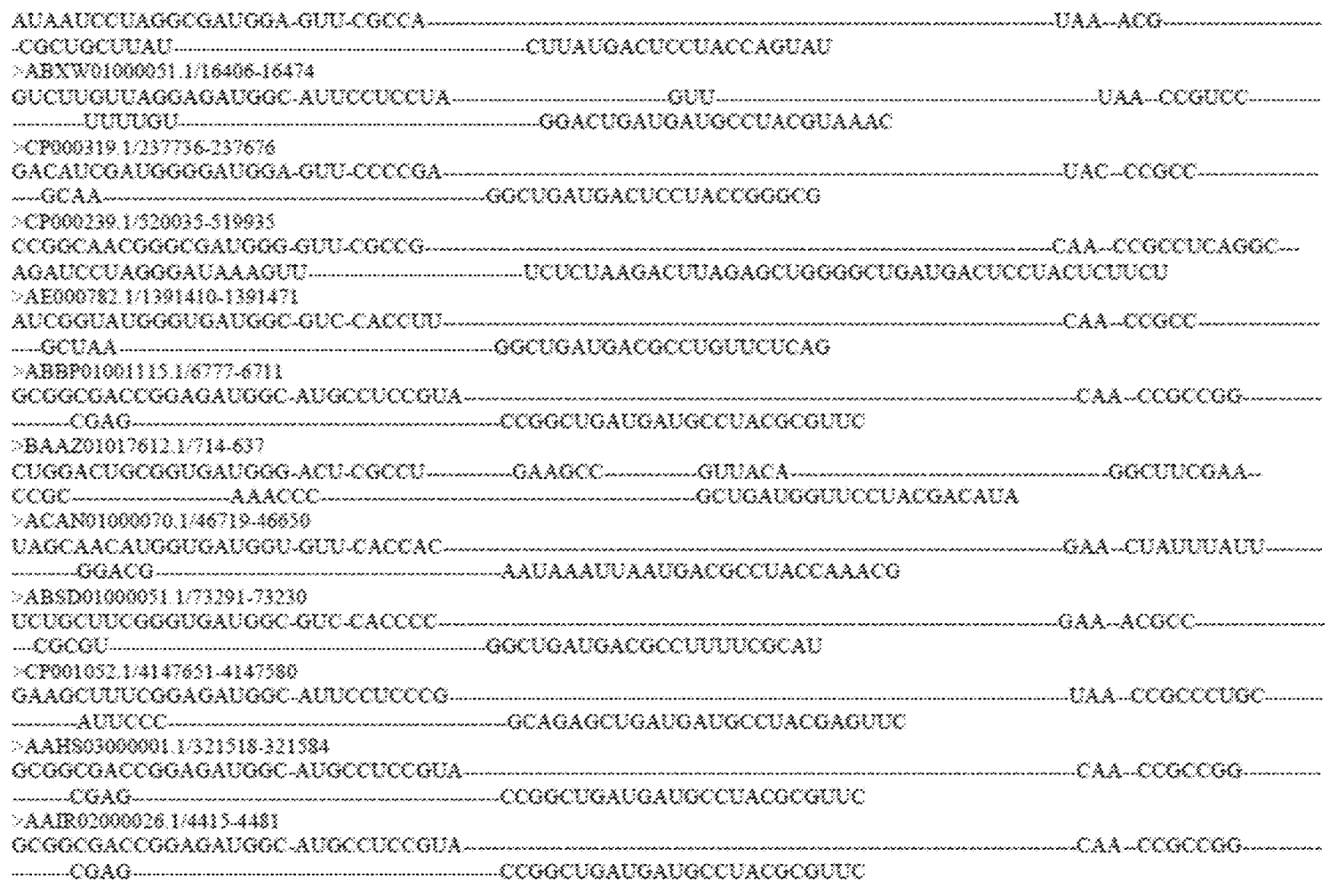
Figure 53:
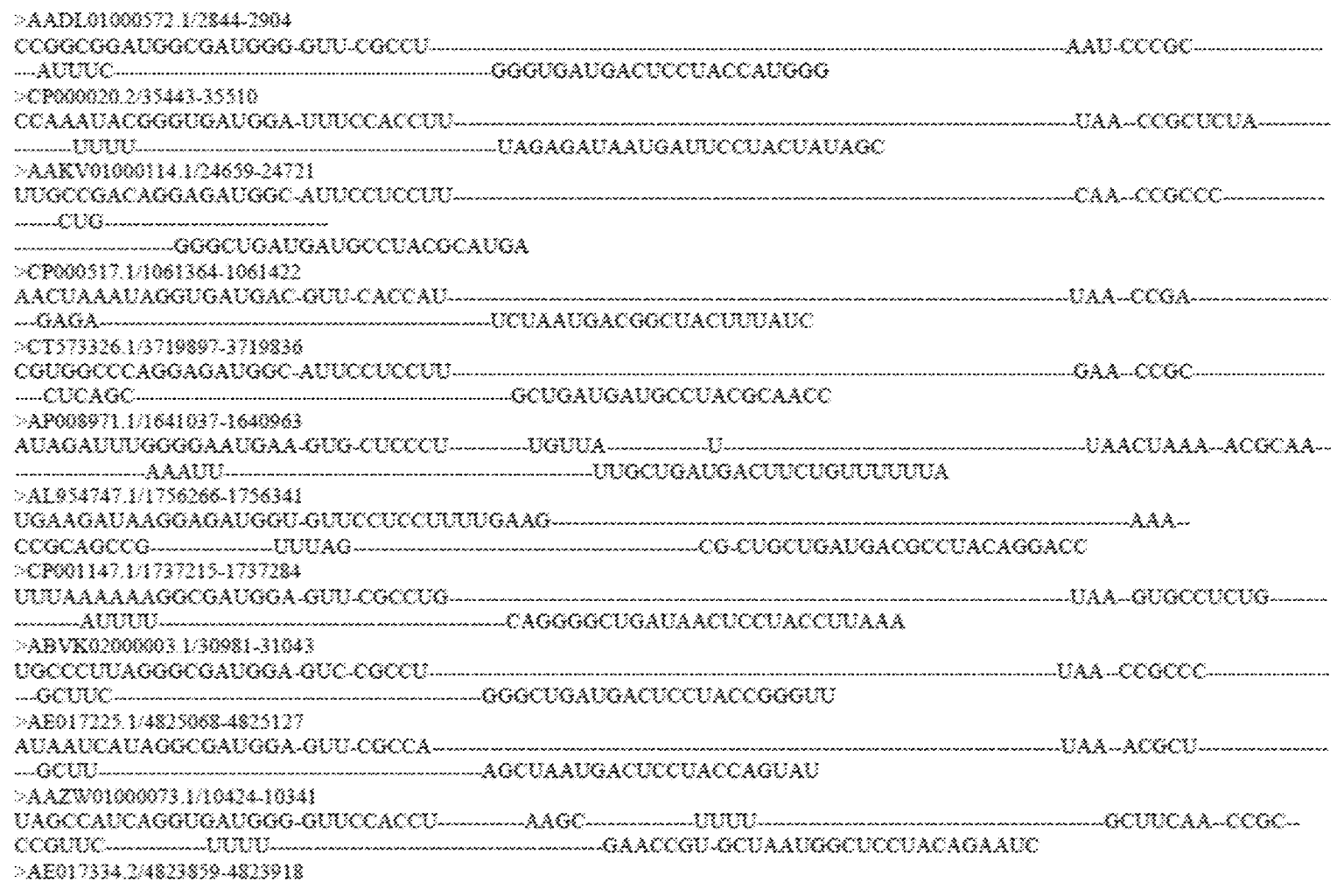
Figure 53:
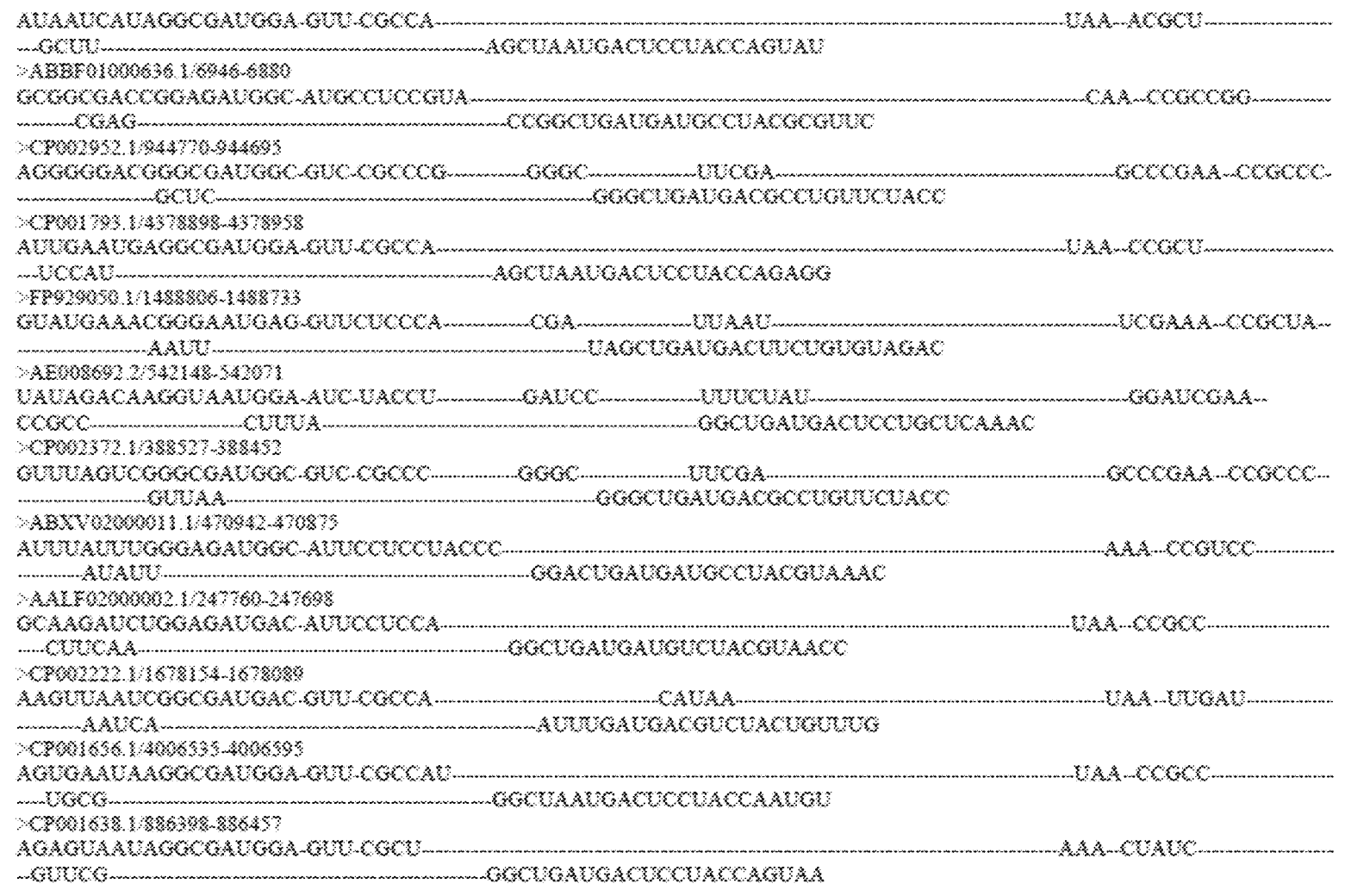

Additional exemplary Fluoride sensing riboswitches are sequences from SEQ ID NO: 205 to SEQ ID NO; 1988 and SEQ ID No: 1999 to SEQ ID NO: 2231 reported in Appendix I of U.S. provisional application No. 62/801,077 and SEQ ID NO: 1989-1998 and SEQ ID NO: 2232-2508 in FIG. 53 of the disclosure which are incorporated herein by reference in its entirety, which contains 2017 exemplary F-sensing riboswitch sequences. An alignment of 287 sequences from the 2017 exemplary F-sensing riboswitch sequences is shown in FIG. 53 (SEQ ID NO: 1989-1998 and SEQ ID NO: 2232-2508) wherein the nucleotide sequences shown are sequences forming a same structure in corresponding aligned sequences and the symbols "- -" indicates gaps between the aligned sequences shown (see Example 20) is also for further guidance concerning sequences and structures of F-sensing riboswitches suitable in constructs in accordance with the present disclosure.

In another, preferred embodiment the F-sensing riboswitch is the F-sensing riboswitch from *Sphingomonas* sp, 67-36 encoded by (SEQ ID NO: 2525)
CATGGTGACGGGGATGGAGTTCCCCGATAACCGCCGTTCCGGGCTGATGA

CTCCTACCAACAC.

In another, preferred embodiment the F-sensing riboswitch is the F-sensing riboswitch from *Pseudomonas Syringae* encoded by (SEQ ID NO: 2526)
CGGCGCATTGGAGATGGCATTCCTCCATTAACAAACCGCTGCGCCCGTAG

CAGCTGATGATGCCTACAGAAAC.

In a more preferred embodiment, the F-sensing riboswitch is MM-1 from *Sphingomonas* encoded by sequence (SEQ ID NO: 2514)
GTCGGCAACGGCAATGGATTCCTGCCGGGCCTCGCGCCGAACCGCCATTG

AGGGCTGATGATTCCTACCTGCGG (See Example 27 and Example 28).

In some embodiments of the $UO_2F_2$-biosensors herein described an F-sensing riboswitch can be comprised within any one of the U-sensing genetic molecular components herein described.

In some embodiments of the $UO_2F_2$-biosensors herein described an F-sensing riboswitch can be comprised in an F-sensing molecular component which is a genetically engineered polynucleotide construct configured to regulate expression of one or more RNA and/or protein-encoding genes through one or more promoter in combination with one or more F-sensing riboswitches. For example, an F-sensing riboswitch can be comprised in an F-sensing genetic reportable molecular component such as the one exemplified in Example 21.

In embodiments, herein described, any fluoride sensing riboswitch is expected to be functional in the host bacterium of interest. The well-characterized fluoride riboswitches from *P. syringae* DC3000 and *Bacillus subtilis* [102] represent exemplary riboswitches for fluoride sensor construction.

In some embodiments the native fluoride riboswitch from the host bacterium (if present) or a closely related bacterium can be used in the biosensors herein described, particularly if the promoter associated with the fluoride riboswitch is to be employed.

The relatedness among bacteria is defined based on taxonomic rank as will be understood by a person skilled in the art. In this connection relatedness among bacteria suitable to be used in biosensor of the present disclosure can be from the following groups Group 1: From the species of interest (e.g., *Caulobacter crescentus*)
Group 2: From the genus of interest (e.g., *Caulobacter*)
Group 3: From the family of interest (e.g., Caulobacteraceae)
Group 4: From the order of interest (e.g. Caulobacterales)
Group 5 From the subclass of interest (e.g., Caulobacteridae)
Group 6: From the class of interest (e.g. Alphaproteobacteria)

"Closely related" bacteria encompass bacteria within a same subclass of interest (group 5) preferably within a same order of interest, more preferably within a same family of interest (Group 2) and more preferably within the same genus/species of interest (Group I).

For example, while *C. crescentus*, a preferred host strain for the U sensor, lacks a native fluoride riboswitch, the uncharacterized fluoride riboswitch from *Sphingomonas* sp. MM-1 are also expected to be usable. This bacterium is closely related to *C. crescentus* and possesses similarly high genomic G+C content, minimizing compatibility risks with *C. crescentus*. Additionally, despite the lack of biochemical characterization, the function of the *Sphingomonas* sp. crcB motif in fluoride sensing is supported by its homology with characterized crcB riboswitches [Pfam database [109]] and its genomic location upstream of a fluoride exporter.

In some embodiments, the genetically modified bacteria are bacteria incapable of natively expressing an F-sensing riboswitch. In some embodiments, the genetically modified bacteria are bacteria capable of natively expressing an F-sensing riboswitch. In some of those embodiments, the endogenous F-sensing riboswitch, are preferably knocked out or disabled through mutagenesis of conserved nucleotides critical for riboswitch function. [102] (see Example 26)

In particular in some embodiment where the native CrcB fluoride exporter functions are maintained the detection limit of the colorimetric crcB reporter (~1 mM) can be adversely affected. In those embodiments, abolishing fluoride export by deletion of the crcB gene yielded a 100-fold improvement in the fluoride detection limit (sub 10 µM) [102]. Achieving a low fluoride detection limit will likely require deletion of the crcB gene or the analogous $eriC^F$ gene in the host organism. [102]

The utility of a fluoride riboswitch for applications in a whole-cell fluoride sensor is supported by the finding that the crcB motif can be appended to the lacZ reporter gene in both *E. coli* and *B. subtilis*, enabling a colorimetric output response over a 100-fold range of fluoride concentrations. [102]. Additional elements and configuration of F-sensing components herein described (including U-sensing F-sensing reportable genetic molecular component, an F-sensing reportable genetic molecular component) can be identified by a skilled person based on the component and the host bacterial cell.

Any fluoride sensing riboswitch and in particular any fluoride sensing riboswitch reported in Appendix I of U.S. provisional application No. 62/801,077, or encompassed by any one of SEQ ID NO: 2509 to SEQ ID NO: 2520, is expected to be employed for fluoride sensor construction, assuming that the promoter and ribosome binding sequence (RBS) are optimized for the organism of interest Any promoter and Ribosome Binding Sequence from a bacteria from the above Groups 1 to Group 6 which is encompassed by a known consensus and has a location upstream of crcB/ericF can be used in connection with each riboswitch sequence from all groups, with preference for promoters from bacteria closely related to the host bacteria of the $UO_2F_2$-biosensors herein described.

Figure 52:
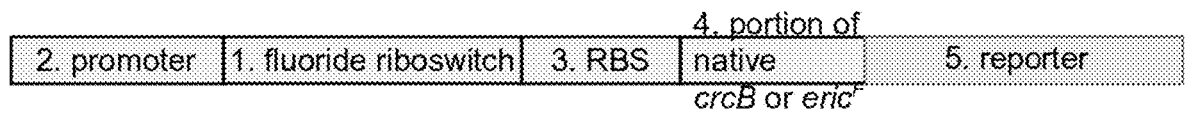
FIG. 52 shows a schematic representation of the primary genetic parts involved in the construction of a fluoride responsive reporter.

An F-sensing riboswitch can be included in any F-sensing molecular component herein described in combination with promoter and RBS in a configuration identifiable by a skilled person. Reference is made in this connection to the schematic of FIG. 52 which shows a schematic representation of the primary genetic parts involved in the construction of a fluoride sensing reporter include a (2) promoter to initiate transcription, a (1) fluoride riboswitch to terminate transcription in the absence of fluoride, a (3) ribosome binding site (RBS) to initiate translation, and a (5) reporter for detection. A portion of the (4) native crcB or eric$^F$ gene may be required for riboswitch function (i.e., coupling fluoride binding with transcriptional termination) of some fluoride riboswitches. The crcB gene is not required for the function of the *Sphingomonas* MM-1 fluoride riboswitch (Example 28).

In embodiments, herein described a skilled person will be able to identify a combination and configuration of an F sensing riboswitch based on the host bacteria by selecting the promoter and ribosome binding sequence (RBS) that are functional, and preferably optimized, for the host, such as a promoter and RBS native to the selected host bacterial cell or the closely related bacteria.

An example of closely related bacteria is provided by *C. crescentus*, and *Sphingomonas* sp. Accordingly, in an exemplary embodiments, a biosensor can be engineered in the preferred host strain for the U sensor *C. crescentus*, which lacks a native fluoride riboswitch with the uncharacterized fluoride riboswitch from *Sphingomonas* sp. MM-1. *Sphingomonas* sp is closely related to *C. crescentus* and possesses similarly high genomic G+C content, minimizing compatibility risks with *C. crescentus*.

Following identification of a promoter and RBS functional for the host bacteria, a suitable F-sensing riboswitch and the related configuration to obtain a desired F-sensitivity in a selected host bacteria can be identified with a method wherein the F-sensing riboswitch, promoter and RBS are tested in the host bacteria to identify a functional F-sensing construct to be used in F-sensing genetic molecular components herein described.

The method comprises selecting an F-sensing riboswitch from the host bacteria or from a closely related bacteria; selecting a promoter native to the selected host bacterial cell or the closely related bacteria, selecting a ribosome binding sequence (RBS) native to the selected host bacteria or the closely related bacteria, and selecting a portion of the crcB/eric$^F$ coding region. The method further comprises providing a candidate F-sensing construct wherein the selected F-sensing riboswitch, the selected native promoter, the selected RBS, and the selected portion of the crcB/eric$^F$ coding region are included in an gene expression cassette together with a reporter in a candidate configuration allowing expression of the reporter in the host bacteria in presence of Fluoride (see configuration schematically illustrated in FIG. 52) The method further comprises introducing the candidate F-sensing construct in the host bacteria for a time and under condition to allow expression of the reporter; and detecting expression of the reporter in presence of a selected F amount to identify an F-sensitivity of the candidate F-sensing construct. The method can further comprise performing the method with additional candidate F-sensing constructs and selecting the candidate F-sensing construct having the desired F-sensitivity.

In embodiments herein described, testing of different F-sensing riboswitches in F-sensing construct according to methods herein described can be performed to identify the combination of F-sensing riboswitches promoter and RSB sequence, number of riboswitches, length of the construct, presence of spacers and additional structural features of the configuration of the construct, resulting in an F-sensing cassette with a desired F sensitivity to the U-biosensor over additional combinations with less desired or no F-sensitivity (see e.g. testing of Examples 27-33).

For example, in some embodiments, an F-sensing construct in *C. crescentus* preferably comprises the *Sphingomonas* MM-1 fluoride riboswitch module which outperformed an analogous module from the more distantly related strain *Pseudomonas syringae* in terms of both signal amplitude and dynamic range (see Example 27 and Example 28).

In another exemplary application, an F-sensing in *C. crescentus* comprises the fluoride riboswitch from the closely related *Sphingomonas* 67-36 in combination with a xylose-inducible promoter (see Example 27 and Example 28).

In some embodiments, an F-sensing construct can comprise two or more F-sensing riboswitches (see Example 29).

In some embodiment, the F-sensing riboswitch can be comprised in an F-sensing construct in combination with the Pxyl promoter. In some of those embodiments the F-sensing riboswitch can be anyone of the F-riboswitches from *Sphingomonas* SP., in particular MM-1 (see e.g. SEQ ID NO: 2514) and *Sphingomonas* 67-36 (see e.g. SEQ ID NO: 2525). In some of these embodiments the F-sensing riboswitch can also be anyone of the F-riboswitches from *Pseudomonas Syringae*. In some of embodiments the F-sensing construct can have sequences SEQ ID NO: 2528, SEQ ID NO: 2519 or SEQ ID NO: 2520, preferably SEQ ID NO2518 (see e.g. Example 28).

In some embodiments, the F-sensing riboswitch can be comprised in an F-sensing construct in combination with a promoter native to the host bacteria, In those embodiments, the F-sensing riboswitch can preferably be an F-sensing riboswitch MM-1 from *Sphingomonas* Sp. (see e.g. SEQ ID NO: 2514).

In some embodiments, the F-sensing riboswitch can be comprised in an F-sensing construct in combination with Pphyt promoter. In those embodiments, the F-sensing riboswitch can preferably be an F-sensing riboswitch MM-1 from *Sphingomonas* Sp. (see e.g. SEQ ID NO: 2514).

In embodiments, herein described, preferably an F-sensing riboswitch is comprised together with other elements such promoters, RBS, Shine Dalgarno sequences and others identifiable by a skilled person in F-sensing constructs in a configuration that has a high signal amplitude (e.g. 25,000-200,000 for a normalized fluorescence signal) and large dynamic range with respect to fluorescence (higher than 100, preferably higher then 1000 and more preferably higher than 10,000)).

The wording "signal amplitude" as used herein with respect to a construct, cassette or component herein described, indicates the difference between the maximum (concentration of analyte such as U or F– that yields the highest signal) and minimum (no analyte, in particular no U and/or F) signal produced by the construct, cassette or component herein described For signal amplitude detected by fluorescence a high signal amplitude is typically a normalized fluorescence signal of 25,000-200,000, wherein the wording normalized fluorescence indicates the fluorescence signal (in arbitrary units)/cell density (OD600).

The wording "dynamic range" as used herein with respect to a construct, cassette or component herein described, indicates is defined as the ratio between the maximum (concentration of analyte such as U and/or F– that yields highest signal) and minimum (no analyte, in particular no U and/or F) signal produced by the construct, cassette or component herein described. A high value for the dynamic range are 100, 1000, or 10,000, wherein a higher dynamic range indicates a better analyte detection as will be understood by a skilled person.

In some embodiments, at least one Fluoride sensing riboswitch herein described can be comprised in combination of at least one a U-sensing genetic molecular component herein described, in a U-sensitive F-sensitive genetic circuit together with a reporter molecular component and/or a U-neutralizing molecular component. In addition or in the alternative, a Fluoride sensing riboswitch can be comprised in an F-sensitive genetic circuit together with a reporter molecular component, the F-sensing genetic circuit to be comprise in a biosensor herein described in combination with a U-sensitive genetic circuit and/or component as will be understood by a skilled person upon reading of the present disclosure.

In particular, in a U-sensitive genetic circuit, the U-sensing genetic molecular component, the reporter molecular component, and/or the U-neutralizing molecular components as well as possibly other components are connected one to another in accordance to a circuit design by activating, inhibiting, binding or converting reactions to form a fully connected network of interacting components.

Similarly for an F-sensing genetic circuit an F-sensing genetic molecular component comprising a fluoride sensing riboswitch and a reporter molecular component (as well as possibly other components) are connected one to another in accordance to a circuit design by activating, inhibiting, binding or converting reactions to form a fully connected network of interacting components when the genetic circuit operates according to the circuit design in presence of bioavailable Fluoride.

In a U-sensitive genetic circuit herein described, at least one molecular component is a U-sensing genetic molecular component in which a U-sensitive promoter having a regulator direct repeat sequence of SEQ ID NO: 1 or any of SEQ ID NO:7-28) is activated or repressed in presence of bioavailable U. In a U-sensitive genetic circuit herein described at least one molecular component is a reportable molecular component and/or a U-neutralizing molecular component when the genetic circuit operates according to the circuit design in presence of bioavailable U. In embodiments wherein at least one of the genetic molecular components of the U-sensitive genetic circuit herein described comprises a Fluoride sensing riboswitch the genetic circuit operates according to the circuit design in presence of bioavailable U and in presence of bioavailable Fluoride.

The term "genetic circuit" as used herein indicates a collection of molecular components connected one to another by biochemical reactions according to a circuit design. In particular, in a genetic circuit the molecular components are connected one to another by the biochemical reactions so that the collection of molecular components is capable to provide a specific output in response to one or more inputs.

In genetic circuits in the sense of the present disclosure, the molecular components forming parts of the genetic circuit can be genetic molecular components or cellular molecular components.

The term "cellular molecular component" indicates a molecular component not encoded by a gene, or indicates a molecular component transcribed and/or translated by a gene but comprised in the circuit without the corresponding gene. Exemplary cellular components comprise polynucleotides, polypeptides, polysaccharides, small molecules and additional chemical compounds that are present in a cellular environment and are identifiable by a skilled person. Polysaccharides, small molecules, and additional chemical compounds can include, for example, NAD, FAD, ATP, GTP, CTP, TTP, AMP, GMP, ADP, GDP, Vitamin B1, B12, citric acid, glucose, pyruvate, 3-phosphoglyceric acid, phosphoenolpyruvate, amino acids, PEG-8000, FiColl 400, spermidine, DTT, b-mercaptoethanol maltose, maltodextrin, fructose, HEPES, Tris-$C_1$, acetic acid, aTc, IPTG, 3OC12HSL, 3OC6HSL, vanillin, malachite green, Spinach, succinate, tryptophan, and others known to those skilled in the art. Polynucleotides can include RNA regulatory factors (small activating RNA, small interfering RNA), or "junk" decoy DNA that either saturates DNA-binding enzymes (such as exonuclease) or contains operator sites to sequester activator or repressor enzymes present in the system (for example, as in [110]). Polypeptides can include those present in the genetic circuit but not produced by genetic components in the circuit, or those added to affect the molecular components of the circuit.

In some embodiments of genetic circuits herein described, one or more molecular components is a recombinant molecular component that can be provided by genetic recombination (such as molecular cloning) and/or chemical synthesis to bring together molecules or related portions from multiple sources, thus creating molecular components that would not otherwise be found in a single source.

In embodiments herein described, a genetic circuit comprises at least one genetic molecular component or at least two genetic molecular components, and possibly one or more cellular molecular components, connected one to another in accordance to a circuit design by activating, inhibiting, binding or converting reactions to form a fully connected network of interacting components.

The term "activating" as used herein in connection with a molecular component of a genetic circuit refers to a reaction involving the molecular component which results in an increased presence of the molecular component in the cellular environment. For example, activation of a genetic molecular component indicates one or more reactions involving the gene, RNA and/or protein of the genetic molecular component resulting in an increased presence of the gene, RNA and/or protein of the genetic molecular component (e.g. by increased expression of the gene of the molecular component, and/or an increased translation of the RNA). An example of "activating" described herein comprises the initiation of expression of a gene regulated by a UzcRS-regulated promoter by a UzcR protein (e.g., see Example 2).

Activation of a molecular component of a genetic circuit by another molecular component of the circuit can be performed by direct or indirect reaction of the molecular components. Examples of a direct activation of a genetic molecular component comprised in a circuit the production of an alternate sigma factor (molecular component of the circuit) that drives the expression of a gene controlled by the alternate sigma factor promoter (other molecular component of the circuit), or the production of a small ribonucleic acid (molecular component of the circuit) that increases expression of a riboregulator-controlled RNA (molecular component of the circuit). Specific examples of this include the activity of sigma28 or sigma54 as demonstrated in [111]. Examples of indirect activation of a genetic molecular component comprise the production of a first protein that inhibits an intermediate transcriptional repressor protein, wherein the intermediate transcriptional repressor protein represses the production of a target gene, such that the first protein indirectly activates expression of the target gene.

The term "inhibiting" as used herein in connection with a molecular component of a genetic circuit refers to a reaction involving the molecular component of the genetic circuit and resulting in a decreased presence of the molecular component in the cellular environment. For example, inhibition of a genetic molecular component indicates one or more reactions involving the gene, RNA and/or protein of the genetic molecular component resulting in a decreased presence of the gene, RNA and/or protein (e.g. by decreased expression of the gene of the molecular component, and/or a decreased translation of the RNA). Inhibition of a cellular molecular component indicates one or more reactions resulting in a decreased production or increased conversion, sequestration or degradation of the cellular molecular components (e.g. a polysaccharide or a metabolite) in the cellular environment.

Inhibition can be performed in the genetic circuit by direct reaction of a molecular component of the genetic circuit with another molecular component of the circuit or indirectly by reaction of products of a reaction of the molecular components of the genetic circuit with another molecular component of the circuit.

The term "binding" as used herein in connection with molecular components of a genetic circuit refers to the connecting or uniting two or more molecular components of the circuit by a bond, link, force or tie in order to keep two or more molecular components together, which encompasses either direct or indirect binding where, for example, a first molecular component is directly bound to a second molecular component, or one or more intermediate molecules are disposed between the first molecular component and the second molecular component another molecular component of the circuit. Exemplary bonds comprise covalent bond, ionic bond, van der Waals interactions and other bonds identifiable by a skilled person.

In some embodiments, the binding can be direct, such as the production of a polypeptide scaffold that directly binds to a scaffold-binding element of a protein. In other embodiments, the binding may be indirect, such as the co-localization of multiple protein elements on one scaffold. In some instances, binding of a molecular component with another molecular component can result in sequestering the molecular component, thus providing a type of inhibition of said molecular component. In some instances, binding of a molecular component with another molecular component can change the activity or function of the molecular component, as in the case of allosteric interactions between proteins, thus providing a type of activation or inhibition of the bound component. An example of "binding" as described herein comprises the binding of UzcR to an m_5 site in a UzcRS-regulated promoter (e.g., see Example 2).

The term "converting" as used herein in connection with a molecular component of the circuit refers to the direct or indirect conversion of the molecular component into another molecular component. An example of this is the conversion of chemical X by protein A to chemical Y that is then further converted by protein B to chemical Z. An example of "converting" as described herein comprises the cleavage of o-nitrophenyl-β-D-galactoside (ONPG) by beta-galactosidase encoded by the lacZ gene (e.g. see Example 1).

In embodiments of the U-sensitive and/or F-sensitive genetic circuits described herein, the molecular components are connected one with another according to a circuit design in which a molecular component is an input and another molecular component is an output. In particular, a genetic circuit typically has one or more input or start molecular component which activates, inhibits, binds and/or convert another molecular component, one or more output or end molecular component which are activated, inhibited, bound and/or converted by another molecular component, and intermediary molecular components each inhibiting, binding and/or converting another molecular component and being activated, inhibited, bound and/or converted by another molecular component. In embodiments of the U-sensitive and/or F-sensitive genetic circuits herein described, the input is bioavailable U and/or bioavailable F and the output is a reportable molecular component and/or a U-neutralizing molecular component.

In some embodiments of the $UO_2F_2$ biosensor herein described the U-sensitive and/or F-sensitive genetic circuits can be comprised together within a same biosensor to detect or to detect and neutralize bioavailable $UO_2F_2$.

In some embodiments of the $UO_2F_2$ biosensor herein described the U-sensitive and/or F-sensitive genetic circuits can be comprised in combination with a U-sensing genetic molecular component and/or a F-sensing genetic molecular component of the disclosure to the detect or to detect and neutralize bioavailable $UO_2F_2$.

In some embodiments of the $UO_2F_2$ biosensor described herein, the U-sensitive F-sensitive genetic circuit can comprise at least one F-sensing genetic molecular component in which RNA is expressed in presence of bioavailable F, and at least one U-sensing genetic molecular component in which a U-sensitive promoter is activated or repressed in presence of bioavailable U, the U sensitive promoter comprising a U-sensitive transcriptional 1362 binding site or a U-sensitive transcriptional UzcR binding site. In addition or in the alternative, in the U-sensing F-sensing genetic circuit, a U-sensing genetic molecular component comprises at least one Fluoride sensing riboswitch. In these embodiments, in the U-sensitive F-sensitive genetic circuit at least one molecular component is a reportable molecular component and/or a U-neutralizing molecular component when the genetic circuit operates according to the circuit design in presence of bioavailable U and bioavailable Fluoride.

Exemplary configurations of an F-sensing bioswitch and a U-sensing genetic molecular component in a $UO_2F_2$ biosensors are shown in Examples 23 to 25.

In some embodiments, the $UO_2F_2$ comprise a U-sensing genetic molecular component and/or a U-sensing genetic circuit in combination with a separate F-sensing genetic molecular component and/or a F-sensing genetic circuit to provide a dual output configuration wherein one or more fluoride riboswitches control the expression of a reportable molecular component configured to be independent of U. Exemplary dual output configurations of the $UO_2F_2$ biosensor herein described are showing in Example 25.

In some embodiments, the $UO_2F_2$ biosensor comprise a U-sensing genetic molecular component and/or a U-sensing genetic circuit in combination with a F-sensing riboswitch integrated in the U-sensing genetic molecular component and/or a U-sensing genetic circuit to provide a single output configuration wherein one or more fluoride riboswitches control the output of the U-sensing genetic molecular component and/or the U-sensing genetic circuit. In particular in those embodiments, the fluoride riboswitch functions to prematurely terminate transcription from a U-activated promoter in the absence of fluoride. Fluoride binding mitigates this termination, enabling gene expression thus providing an output in presence of bioavailable U and Fluoride. Exemplary single output configurations of the $UO_2F_2$ biosensor herein described are shown in Example 24.

Exemplary configurations of $UO_2F_2$ biosensors herein described are reported below and in the Examples sections.

In particular, an exemplary genetic circuit described herein comprises, a U sensing genetic molecular component in which a U-sensitive promoter such as $P_{phyt}$ or a $P_{1361}$ is configured to initiate expression of a lacZ gene encoding the beta-galactosidase enzyme (U-sensing genetic molecular component), wherein the beta-galactosidase enzyme converts the substrate ONPG (cellular molecular component) to yield galactose and o-nitrophenol which has a yellow color (reportable molecular component). In some of these embodiments, the genetic molecular components can further comprise a Fluoride sensing riboswitch (e.g. any one of the crcB riboswitches herein described) in a configuration which allows the expression of the lacZ gene in presence of an effective amount of bioavailable fluoride in a single output configuration as will be understood by a skilled person. In addition or in the alternative, the $UO_2F_2$ biosensor can further comprise the F-sensing riboswitch in a separate F-sensing reportable genetic molecular component and/or a separate F-sensing genetic circuit to provide a dual output configuration.

In some embodiments of the $UO_2F_2$ biosensor, the U-sensitive genetic circuit comprises at least one U-sensing genetic molecular component in which a U-sensitive promoter is activated or repressed in presence of bioavailable U, the U sensitive promoter comprising a U-sensitive transcriptional 1362 binding site and the U sensitive genetic circuit is comprised in the biosensor together with an F-sensitive reportable genetic molecular component comprising an F-sensitive riboswitch herein described configured to be expressed in presence of an effective amount of bioavailable Fluoride in a dual output configuration. In these embodiments, in the U-sensitive genetic circuit at least one molecular component is a reportable molecular component and/or a U-neutralizing molecular component when the genetic circuit operates according to the circuit design in presence of bioavailable U as will be understood by a skilled person. In some embodiments, the U-sensitive genetic circuit further comprises at least one genetic molecular component in which a UzcRS two-component system regulated promoter is activated or repressed in presence of bioavailable U.

In an exemplary embodiment of the U-sensitive genetic circuit described herein, at least one U-sensitive genetic molecular component comprises a U-sensitive promoter such as $P_{phyt}$ or a $P_{1361}$ configured to initiate expression of a uzcS gene (CCNA_02842) and a uzcR gene (CCNZ_02485), encoding proteins UzcS and UzcR, respectively (first U-sensing genetic molecular component) and further comprises a second U-sensing genetic molecular component in which a UzcRS two-component system regulated promoter is configured to initiate expression of a reporter gene (e.g. GFP, an exemplary reportable molecular component), in which binding of UzcR protein to the UzcRS-regulated promoter activates the UzcRS-regulated promoter (see Example 2). As understood by those skilled in the art, uzcS and uzcR are genes that are natively comprised in a uzcRS operon in Caulobacter and other alphaproteobacteria, as described in Park et al., 2017 [3].

The term "uzcRS operon" as used herein refers to the genetically encoded UzcRS two-component system, comprising the uzcS gene (CCNA_02842) and the uzcR gene (CCNZ_02485), and operatively linked promoters and regulatory elements [3]. In an exemplary C. crescentus NA1000 genome, uzcR and uzcS are physically separated by genes parD3 and parE3 encoding the ParDE3 toxin antitoxin (TA) system, together forming a putative four-gene operon [3, 112]. Although uzcR and uzcS are conserved throughout alphaproteobacteria, the insertion of parDE3 between uzcR and uzcS is unique to a subset of the Caulobacter genus; uzcR and uzcS are adjacently located in the majority of closely related alphaproteobacteria [3] including C. crescentus OR37, an environmental isolate from a U-contaminated site [97].

Accordingly, in some embodiments of the $UO_2F_2$ biosensors described herein, the U biosensor can be any genetically engineered proteobacteria and in particular a genetically engineered Caulobacteridae which comprises a UzcRS two component system.

In some preferred embodiments, a U-sensitive genetic circuit further comprises one or more genetic molecular components comprising one or more negative regulators of UzcRS that function to maintain UzcRS in an OFF state in absence of metal (see Example 9). In particular, in some exemplary embodiments, the $UO_2F_2$ biosensor described herein comprises a chromosomal copy of UzcRS negative regulators 1 and 2 (Example 9) under transcriptional regulation of their native promoters. In other embodiments, one or more genetic molecular components comprising exemplary UzcRS negative regulators 1 and 2 are placed under control of inducible transcriptional regulatory elements in order to desensitize UzcS to a particular signal. For example, overexpression of CCNA_03680-CCNA_03681 reduces the sensitivity of UzcRS for Zn and Cu. In some embodiments, the MarR-type regulators CCNA_03498 and/or CCNA_02289 can be deleted in the host Caulobacteridae genome to increase sensitivity of uzcRS for U.

In some of the embodiments of the U-sensitive genetic circuit in which at least one U-sensitive genetic molecular component comprises a U-sensitive promoter such as $P_{phyt}$ or a $P_{1361}$ configured to initiate expression of a uzcS gene (CCNA_02842) and a uzcR gene (CCNZ_02485), a fluoride riboswitch can be integrated between the UzcRS-regulated promoter and the GFP gene and/or between the $P_{phyt}$ or $P_{1361}$ promoter and the uzcS ATG to provide a U-sensing F-sensing genetic circuit in a single output configuration. In addition or in the alternative, a riboswitch can be comprised in the $UO_2F_2$ biosensor in a separate F-sensing reportable genetic molecular component and/or in a separate F-sensing genetic circuit herein described in a dual output configuration.

In some cases of these embodiments or other embodiments herein described, riboswitch performance is expected to be adversely affected by changes in genomic context, such as fusing the riboswitch to a reporter gene. Accordingly, in any embodiments herein described, if an initial transcriptional fusion to a reporter (such as GFP) fails, a Ribo-attenuator, a recently developed genetic element that insulates the riboswitch from genomic context and enhances the tunability (e.g., sensitivity, cell-to-cell variability, etc.), will be used to build a riboswitch reporter (e.g. a CrcB reporter). This approach was successfully applied with various elements such as in construction of GFP fusions with the addA (2-aminopurine) and btuB (adenosylcobalamin) riboswitches [113].

In an exemplary embodiment of the U-sensitive F-sensitive genetic circuits described herein, the U-sensitive genetic circuit comprises a U-sensitive promoter such as $P_{phyt}$ or a $P_{1361}$ configured to initiate expression of a hrpS gene encoding an HrpS protein (first U-sensing genetic molecular component) and further comprises a second U-sensing genetic molecular component in which a UzcRS two-component system regulated promoter is configured to initiate expression of an hrpR gene encoding an HrpR protein. The U-sensitive F-sensitive genetic circuit further comprises a fourth genetic molecular component comprising a hrpL promoter ($P_{hrpL}$) configured to initiate expression of a reporter gene (e.g. GFP, an exemplary reportable molecular component), in which binding of both HrpS and HrpR are required for $\sigma^{54}$ dependent activation of the $P_{hrpL}$ and expression of HrpS or HrpR alone is not sufficient for transcriptional activation. (see Example 3). In these embodiments a fluoride riboswitch could be integrated in three positions 1) Between the $P_{phyt}$ or $P_{1361}$ promoter and hrpS; 2); 2) between the UzcRS-regulated promoter and the hrpR; and/or between the $P_{hrpL}$ promoter and gfp to provide a U-sensitive F-sensitive genetic circuit with a single output configuration. In the addition or in the alternative, a riboswitch can be comprised in the $UO_2F_2$ biosensor in a separate F-sensing reportable genetic molecular component and/or in a separate F-sensing genetic circuit herein described in a dual output configuration.

As understood by those skilled in the art, hrpR and hrpS refer to genes that are natively comprised in a $\sigma^{54}$ dependent hrpR/hrpS hetero-regulation module from the hrp (hypersensitive response and pathogenicity) system for Type III secretion in *Pseudomonas syringae* [114-116], wherein both HrpS and HrpR are required for $\sigma^{54}$ dependent activation of the hrpL promoter ($P_{hrpL}$) and expression of HrpS or HrpR alone is not sufficient for transcriptional activation.

In some embodiments of the U-sensitive and/or F-sensitive genetic circuits described herein, at least two genetic molecular components comprise complementary protein fragments of a transcription factor, which are configured to associate together to form a functional transcription factor, such as those based on a bacterial two-hybrid system.

As would be understood by those skilled in the art, the term "bacterial two-hybrid" as used herein refers to a technique used to detect protein-protein interactions and protein-DNA interactions by testing for physical interactions (such as binding) between two proteins or a single protein and a DNA molecule, respectively. As understood by those skilled in the art, the bacterial two-hybrid system relies on the activation of downstream reporter gene(s) upon binding of a transcription factor onto an upstream activating sequence (UAS), wherein the transcription factor is split into two separate fragments, called the binding domain (BD) and activating domain (AD). The BD is a domain configured to bind to the UAS and the AD is a domain configured to activate transcription of the operatively linked gene. Thus, the bacterial two-hybrid system is a protein-fragment complementation assay that requires both the BD and the AD for reporter expression. An exemplary bacterial two-hybrid system utilizes an *E. coli* omega protein, which copurifies with RNA polymerase, and can function as a transcriptional activator when linked covalently to a DNA-binding protein. The *E. coli* omega protein can function as an activation target when this covalent linkage is replaced by a pair of interacting polypeptides fused to the DNA-binding protein and to omega, respectively [117].

Accordingly, in an exemplary embodiment of a U-sensitive genetic circuits described herein, the U-sensitive genetic circuit comprises a U-sensitive promoter such as $P_{phyt}$ or a $P_{1361}$ configured to initiate expression of a BD gene encoding an BD protein (first U-sensing genetic molecular component), and further comprises a second U-sensing genetic molecular component in which a UzcRS two-component system regulated promoter is configured to initiate expression of an AD gene encoding an AD protein. The U-sensitive genetic circuit further comprises a fourth genetic molecular component comprising a promoter comprising binding sites for the BD and the AD, configured to activate expression of the reporter gene, e.g. GFP or the U-neutralizing gene (third genetic molecular component), in which binding of both BD and AD are required activation of the third genetic molecular component and expression of the reportable molecular component and/or the U-neutralizing molecular component (see Example 5). For example, it is expected that a 1363/1362 regulated promoter (e.g., $P_{phyt}$) can be used to initiate expression of alpha-gal11$^P$ (an exemplary AD), and a UzcRS regulated promoter (e.g., $P_{urcB}$) can be used to initiate expression of λ-gal4 (an exemplary BD) and $P_{lacOR2\text{-}62}$ that contains the UAS to initiate expression of a reporter gene, such as GFPmut3 (see Example 5). In those embodiments a fluoride riboswitch could be integrated in three positions: 1) Between the $P_{phyt}$ or $P_{1361}$ promoter and BD; 2) Between the UzcRS-regulated promoter and AD and/or 3)) Between the BD/AD-regulated promoter and gfp to provide a U-sensitive F-sensitive genetic circuit with a single output configuration. In the addition or in the alternative, a riboswitch can be comprised in the $UO_2F_2$ biosensor in a separate F-sensing reportable genetic molecular component and/or in a separate F-sensing genetic circuit herein described in a dual output configuration.

In some embodiments of the U biosensor, the U-sensitive genetic circuit comprises at least one U-sensing genetic molecular component in which a U-sensitive promoter is activated or repressed in presence of bioavailable U, the U sensitive promoter comprising a U-sensitive transcriptional 1362 binding site and/or a UzcR binding site together. In these embodiments, in the U-sensitive genetic circuit at least one molecular component is a reportable molecular component and/or a U-neutralizing molecular component when the genetic circuit operates according to the circuit design in presence of bioavailable U, wherein the reportable genetic component and/or a U-neutralizing molecular component is formed by an assembly of two or more subunits of the reportable molecular component and/or a U-neutralizing molecular component. In some embodiments where a 1362 binding site is present, the U-sensitive genetic circuit further preferably comprises at least one genetic molecular component in which an UzcRS two-component system regulated promoter is activated or repressed in the presence of bioavailable U and bioavailable F. In those embodiments, a Fluoride riboswitch could be integrated in two positions: 1) between the $P_{phyt}$ or $P_{1361}$ promoter and U neutralizing gen; and/or 2) Between the UzcRS-regulated promoter and U neutralizing gene to provide a U-sensitive F-sensitive genetic circuit with a single output configuration. In the addition or in the alternative, a riboswitch can be comprised in the $UO_2F_2$ biosensor in a separate F-sensing reportable genetic molecular component and/or in a separate F-sensing genetic circuit herein described in a dual output configuration.

In an exemplary embodiment of the U-sensitive genetic circuits described herein (see Example 4), the U-sensitive F-sensitive genetic circuit comprises a U-sensitive promoter such as $P_{phyt}$ or a $P_{1361}$ configured to initiate expression of a gfp10-K1 fusion gene encoding a GFP10-K1 fusion protein (first U-sensing genetic molecular component) and further comprises a second U-sensing genetic molecular component in which a UzcRS two-component system regulated promoter is configured to initiate expression of an E1-gfp11 gene encoding E1-GFP11 fusion protein. The U-sensitive genetic circuit further comprises a third genetic molecular component comprising a gfp1-9 gene regulated by a non-U-responsive, xylose inducible promoter ($P_{xyl}$), a constitutively active promoter (e.g., $P_{rsaA}$) or by $P_{phyt}$/$P_{1361}$. In some of those embodiments, a Fluoride riboswitch can be integrated in three positions: 1) between the $P_{phyt}$ or $P_{1361}$ promoter and gfp10-K1; 2) between the UzcRS-regulated promoter and E1-gfp11; and/or 3) Between constitutive promoter and gfp-1-9 to provide a U-sensitive F-sensitive genetic circuit with a single output configuration. In the addition or in the alternative, a riboswitch can be comprised in the $UO_2F_2$ biosensor in a separate F-sensing reportable genetic molecular component and/or in a separate F-sensing genetic circuit herein described in a dual output configuration.

Accordingly, the term "tripartite GFP" as used herein refers to a GFP reporter that requires expression and assembly of GFP10, GFP11 and GFP1-9 together for GFP reporter function [5]. As understood by those skilled in the art, tripartite GFP assembly and reporter function is based on tripartite association between two twenty amino-acids long GFP tags, GFP10 and GFP11, which are fused to interacting protein partners, in addition to a complementary GFP1-9 detector. When the interacting protein partners interact, GFP10 and GFP11 self-associate with GFP1-9 to form a functional GFP [5]. In embodiments described herein, any protein interaction pair can be used for the tripartite system. Exemplary interacting protein partners comprise oppositely charged K1/E1 coiled coils, FKBP12-FRB rapamycin inducible protein interaction [5], or the leucine zipper of GCN4 [118] among others known to those skilled in the art.

In some embodiments of the $UO_2F_2$ biosensor, a U-sensitive genetic circuit can comprise at least one U-sensing genetic molecular component in which a U-sensitive promoter is activated or repressed in the presence of bioavailable U, the U sensitive promoter comprising a U-sensitive transcriptional 1362 binding site and/or a UzcR binding site. In these embodiments, in the U-sensitive genetic circuit at least one molecular component is a reportable molecular component and/or a U-neutralizing molecular component when the genetic circuit operates according to the circuit design in the presence of bioavailable U, wherein the reportable molecular component and/or the U-neutralizing molecular component is post-transcriptionally and/or post-translationally converted by the U-sensitive F-sensitive genetic circuit in presence of bioavailable U. In some embodiments wherein at least one of the U sensing promoter is 1362 binding sites, the U-sensitive genetic circuit further preferably comprises at least one genetic molecular component in which a UzcRS two-component system regulated promoter is activated or repressed in presence of bioavailable U and bioavailable F.

Accordingly, in an exemplary embodiment of the U sensing genetic molecular components described herein, the U-sensitive genetic molecular component comprises a U-sensitive promoter such as $P_{phyt}$ or a $P_{1361}$ configured to initiate expression of a protease configured to cleave at a cleavage sequence comprised in a linker peptide in a Firster resonance energy transfer (FRET) sensor protein (first U-sensing genetic molecular component), and further comprises a second U-sensing genetic molecular component in which a UzcRS two-component system regulated promoter is configured to initiate expression of the FRET sensor protein. Thus, in presence of bioavailable U, the U-sensitive genetic circuit is configured to express and cleave the FRET sensor protein. In those embodiments, a fluoride sensing riboswitch can be integrated in two positions: 1) between the $P_{phyt}$ or $P_{1361}$ promoter and FRET protein 1 and/or 2) between the UzcRS-regulated promoter and FRET protein 2 to provide a U-sensitive F-sensitive genetic circuit with a single output configuration. In the addition or in the alternative, a riboswitch can be comprised in the $UO_2F_2$ biosensor in a separate F-sensing reportable genetic molecular component and/or in a separate F-sensing genetic circuit herein described in a dual output configuration.

As understood by those skilled in the art, the terms "Firster resonance energy transfer", "FRET", "fluorescence resonance energy transfer", "resonance energy transfer", "RET" or "electronic energy transfer", and "EET" as used herein refers to a mechanism describing energy transfer between two light-sensitive molecules (chromophores) [119]. A donor chromophore, initially in its electronic excited state, can transfer energy to an acceptor chromophore through nonradiative dipole-dipole coupling [120]. The efficiency of this energy transfer is inversely proportional to the sixth power of the distance between donor and acceptor, making FRET extremely sensitive to small changes in distance. Measurements of FRET efficiency can be used to determine if two fluorophores are within a certain distance of each other [121]. Such measurements can be used as a research tool in fields such as biology and chemistry. For example, one common pair fluorophores for biological use is a cyan fluorescent protein (CFP)—yellow fluorescent protein (YFP) pair [122]. Both are color variants of green fluorescent protein (GFP). Thus, for example, a genetically-encoded fusion of CFP and YFP covalently linked by a protease cleavage sequence can be used as a cleavage assay, wherein if the linker is intact, excitation at the absorbance wavelength of CFP (414 nm) causes emission by YFP (525 nm) due to FRET. If the linker is cleaved by a protease, FRET is abolished and emission is at the CFP wavelength (475 nm) [123].

In some embodiments, a $UO_2F_2$ biosensor herein described comprises two or more U-sensitive genetic molecular components and/or U-sensitive genetic circuits, wherein each of the U-sensitive genetic molecular components expresses a different reporter gene and/or a U-neutralizing gene, and/or each of the U-sensitive genetic circuits comprise a different reportable molecular component and/or U-neutralizing molecular component, in presence of bioavailable U.

For example, exemplary different reportable molecular components can comprise a first genetically-encoded reporter (e.g., GFP) and a second, different genetically-encoded reporter (e.g., dsRED). In those embodiments, a Fluoride riboswitch can be integrated in two positions: 1) between the $P_{phyt}$ or $P_{1361}$ promoter and reportable molecular component 1 and/or U-neutralizing molecular component 1; and/or 2) between the UzcRS-regulated promoter and reportable molecular component 2 and/or U-neutralizing molecular component 2 to provide a U-sensitive F-sensitive genetic circuit with a single output configuration. In the addition or in the alternative, a riboswitch can be comprised in the $UO_2F_2$ biosensor in a separate F-sensing reportable genetic molecular component and/or in a separate F-sensing genetic circuit herein described in a dual output configuration.

In some embodiments, the $UO_2F_2$ biosensors described herein can comprise a UzcRS U-sensitive genetic molecular component comprising a reporter gene or a U-neutralizing gene operatively connected to a UzcRS-regulated promoter, such as $P_{urcA}$, $P_{urcB}$, and others identifiable by those skilled in the art, such as those described in Park et al., (2017) [3]. In those embodiments, the UzcRS U-sensitive genetic molecular component can be comprised in the biosensor alone or in combination with a 1363/1362 U sensitive genetic molecular component comprising a reporter gene or a U neutralizing gene operatively connected to a 1362 regulated promoter. In those embodiments, a Fluoride riboswitch can be integrated in two positions: 1) Between the $P_{phyt}$ or $P_{1361}$ promoter and reportable molecular component 1 and/or U-neutralizing molecular component; and/or 2) Between the UzcRS-regulated promoter and reportable molecular component 2 and/or U-neutralizing molecular component 2.

In the $UO_2F_2$ biosensors described herein, one or more genetic molecular components of the U-sensitive F-sensitive genetic circuits described herein can comprise genomic DNA of the proteobacterial cell and in particular of the Caulobacteridae cell. The one or more genetic molecular components can comprise native genomic DNA in the Caulobacteridae cell or can be introduced into the genome of the Caulobacteridae cell through genetic engineering, or comprised in the Caulobacteridae cell in one or more extra-genomic polynucleotides or vectors, using standard genetic engineering methods known to those skilled in the art and described herein.

In embodiments described herein, the $UO_2F_2$ biosensors—can detect uranium in a range dependent on the composition of the growth media since media components influence bioavailability. The bioavailability of both compounds will be dictated by the composition of the growth media/the chemical composition of the environmental sample In the $UO_2F_2$ biosensors herein described comprising one or more U-sensitive genetic molecular components, in the absence of bioavailable U, 1362 is not bound to the 1362 binding site of a 1362 U-sensitive genetic molecular component and/or UzcR is not bound to an m_5 site of the UczR U-sensitive genetic molecular component, and reporter gene and/or U-neutralizing gene is not expressed. In a second target range, in presence of bioavailable U, 1362 is bound to the 1362 binding site of the U-sensitive genetic molecular component and/or UzcR is not bound to an m_5 site of the U-sensitive genetic molecular component, and the reporter gene and/or U-neutralizing gene is expressed.

In the $UO_2F_2$ biosensors herein described comprising one or more F-sensitive genetic molecular components, in the absence of bioavailable F, the fluoride riboswitch will not bind F and transcription will be prematurely terminated. In the presence of bioavailable F, the fluoride riboswitch will bind F and transcription initiation will occur.

In some embodiments, a U-sensing genetic molecular component and/or U sensing genetic circuits herein described comprising UzcR binding site and a UzcRS TCS can detect Uranium in ~1 micromolar concentrations as will be understood by a skilled person upon reading of the present disclosure. In some embodiments a U-sensing genetic molecular component and/or U sensing genetic circuits herein described comprising 1362 binding site and a 1363/1362 TCS can detect Uranium at ~500 nM in aqueous conditions lacking Pi or glycerol-phosphate as will be understood by a skilled person upon reading of the present disclosure. In embodiments herein described wherein the U-sensing genetic circuit is integrated with a F-sensing riboswitch in a single output configuration and/or an F sensing molecular component or circuit in a dual output configuration, the biosensor U sensitivity is expected to be about the same and therefore can detect Uranium at ~500 nM in aqueous conditions lacking Pi or glycerol-phosphate as will be understood by a skilled person upon reading of the present disclosure In the $UO_2F_2$ biosensors herein described comprising a U-sensitive and/or F-sensitive genetic circuit comprising one or more F sensing riboswitches activated in presence of bioavailable F, one or more U-sensing genetic molecular components in which a U-sensitive promoter is activated or repressed in presence of bioavailable U, the U sensitive promoter comprising a U-sensitive transcriptional 1362 binding site and/or a UczR binding site, in a first target range of bioavailable U the endogenous proteobacteria U-sensitive transcriptional regulator is not bound to the 1362 binding site and/or the UczR binding site of the U-sensitive promoter and the U-sensitive F-sensitive genetic circuit does not comprise a reportable molecular component and/or a U-neutralizing molecular component, when the genetic circuit operates according to the circuit design. In a second target range of bioavailable U and bioavailable F, the endogenous proteobacteria U-sensitive transcriptional regulator is bound to the 1362 binding site and/or to the UzcR binding site of the U-sensitive promoter and the U-sensitive genetic circuit comprises a reportable molecular component and/or a U-neutralizing molecular component when the genetic circuit operates according to the circuit design. In those embodiments, the fluoride riboswitch will not bind F and transcription will be prematurely terminated. In the presence of bioavailable F, the fluoride riboswitch will bind F and transcription initiation will occur, resulting in activation of the reportable element and the single output of the circuit.

In some of those embodiments, a U-sensitive genetic circuit which comprises a 1362 binding site further comprises at least one genetic molecular component comprising a UzcRS-regulated promoter comprising a UzcR binding site. In these embodiments, in the second target range of bioavailable U concentration, activation or repression of the UzcRS-regulated promoter is also required as an input for the U-sensitive genetic circuit to comprise a reportable molecular component and/or a U-neutralizing molecular component when the genetic circuit operates according to the circuit design, wherein activation or repression of the U-sensitive promoter comprising the regulator direct repeat together with activation or repression of the UzcRS-regulated promoter is herein referred to as an "AND gate", wherein the term "AND" is an operation of Boolean logic.

As would be understood by persons skilled in the art, Boolean logic is a branch of algebra in which the values of the variables are the truth values 'true' and 'false', usually denoted by the digital logic terms '1' and '0' respectively. Instead of elementary algebra where the values of the variables are numbers, and the main operations are addition and multiplication, the main operations of Boolean logic are the conjunction 'AND', the disjunction 'OR', and the negation 'NOT'. As understood by those skilled in the art, it is thus a formalism for describing logical relations in the same way that ordinary algebra describes numeric relations. The term "AND gate" refers to a digital logic gate that implements logical conjunction—it behaves according to the truth table shown in Table 1. A 'true' output (1) results only if both the inputs to the AND gate are 'true' (1). If neither or only one input to the AND gate is 'true' (1), a 'false' (0) output results. Therefore, the output is always 0 except when all the inputs are 1.

TABLE 1

'AND gate' truth table:

| Input | | Output |
|---|---|---|
| A | B | A AND B |
| 0 | 0 | 0 |
| 0 | 1 | 0 |
| 1 | 0 | 0 |
| 1 | 1 | 1 |

In particular, the term "AND gate" as used herein refers to the logical relation between two genetic molecular components in a U-sensitive genetic circuit, wherein inputs 'A' and 'B' in Table 1 are two independently activated or repressed genetic molecular components, wherein a first independently activated or repressed genetic molecular component comprises a first promoter having a U-sensitive transcriptional 1362 binding site, and a second independently activated or repressed genetic molecular component comprises a UzcRS-two-component system regulated promoter, and the output 'A AND B' in Table 1 is the reportable molecular component and/or a U-neutralizing molecular component of the U-sensitive genetic circuit.

As would be understood by those skilled in the art, any 'AND gate' genetic system can be employed in the U-sensitive genetic circuits described herein, such as those described in [124, 125].

In some embodiments, the U-sensitive genetic circuits described herein comprise U-sensing genetic molecular components whose expression is regulated independently by (1) a U-sensitive promoter comprising a 1362 binding site, such as $P_{phyt}$ or $P_{1361}$ and (2) UzcRS two-component system, and comprise an AND gate wherein 'inputs' of activation or repression of both (1) a U-sensitive promoter comprising a 1362 binding site, such as $P_{phyt}$ or $P_{1361}$ and (2) UzcRS two-component system-regulated promoter is required for the reportable molecular component 'output' and/or the U-neutralizing molecular component 'output' according to the U-sensitive genetic circuit design (FIG. 3).

In some embodiments of the U-sensitive and/or F-sensing genetic circuit, an F-sensing component and/or a U-sensing genetic molecular component, independently activated or repressed, are arranged 'in series' in the U-sensitive genetic circuit. In an 'in-series' AND gate of a U-sensitive F-sensitive genetic circuit, output of the reportable molecular component and/or the U-neutralizing molecular component according to the genetic circuit design requires two or more of the independently activated or repressed F-sensing genetic molecular component and U-sensing genetic molecular components to be activated or repressed in temporal succession, wherein the activation or repression of the F-sensing genetic molecular component precedes the activation or representation of a first independently activated or repressed U-sensing genetic molecular component which on its turn can precede the activation or repression of a second independently activated or repressed U-sensing genetic molecular component.

The term "in series" as used herein refers to a genetic circuit in which genetic molecular components are connected through biochemical reactions along a single linear circuit path. With regard to Table 1, in an 'in series' AND gate, the temporal sequence of the activation or repression of the independently activated U-sensing genetic molecular components denoted by inputs 'A' and 'B' is such that the second input 'B' is dependent on a prior activation or repression of the first input 'A' in linear succession according to the genetic circuit design.

In exemplary embodiments described herein, an in-series AND gate comprised in a U-sensitive genetic circuit comprises, a first U-sensing genetic molecular component comprising a U-sensitive promoter having a 1362 binding site, such as a $P_{1361}$ promoter or a $P_{phyt}$ promoter, and optionally further comprises a UzcRS two component system-dependent promoter, wherein expression of a uzcR and uzcS genes are under the transcriptional control of a U-sensitive promoter comprising a 1362 binding site, such as a $P_{1361}$ promoter or a $P_{phyt}$ promoter (see Example 2).

In some embodiments of the U-sensitive and/or F-sensing genetic circuits herein described, at least two independently activated or repressed U-sensing genetic molecular components are arranged 'in parallel' in the U-sensitive genetic circuit, herein referred to as an 'in parallel' AND gate. With regard to Table 1, in contrast to the 'in series' AND gate, in an 'in parallel' AND gate, the temporal sequence of inputs 'A' and 'B' is such that a second input 'B' is not dependent on a prior first input 'A' in linear succession, but rather inputs 'A' and 'B' can occur simultaneously. In other words, the term "in parallel" as used herein refers to a genetic circuit in which genetic molecular components are connected through biochemical reactions along more than one circuit path.

In an 'in parallel' AND gate system, output of the reportable molecular component and/or the U-neutralizing molecular component according to the genetic circuit design requires two or more of the independently activated or repressed F-sensing genetic molecular component and/or one or more U-sensing genetic molecular components to be activated or repressed in parallel.

In several embodiments herein described, the in-parallel AND gate comprised in a U-sensitive genetic circuit comprises at least two independently activated or repressed U-sensing genetic molecular components, each comprising a different promoter, (1) a U-sensitive promoter comprising a 1362 direct repeat binding site, such as a $P_{1361}$ or $P_{phyt}$, and (2) a UzcRS-regulated promoter, wherein promoters (1) and (2) act as independently activated or repressed parallel inputs into the U-sensitive genetic circuit, functioning as two independent points of U-sensing in response to their respective U-sensitive transcriptional regulators. In these embodiments, the reportable molecular component output and/or a U-neutralizing molecular component output of the U-sensitive F-sensitive genetic circuit is present only when both of the two independently activated or repressed F-sensing genetic molecular component and U-sensing genetic molecular component are activated or repressed according to the U-sensing genetic circuit design.

Thus, in several embodiments, a U-sensitive F-sensitive genetic circuit comprising an 'in parallel' AND gate for more than one U sensing genetic molecular component, can provide improved selectivity for U, as output of the reportable molecular component and/or the U-neutralizing molecular component is dependent on two independent points of U-sensing in response to two different U-sensitive transcriptional regulators. Persons skilled in the art will recognize that this also reduces the probability of a false positive output, in the first target range of bioavailable U concentration, such as in response to non-U stimuli (such as Zn or Cu).

Figure 6A:
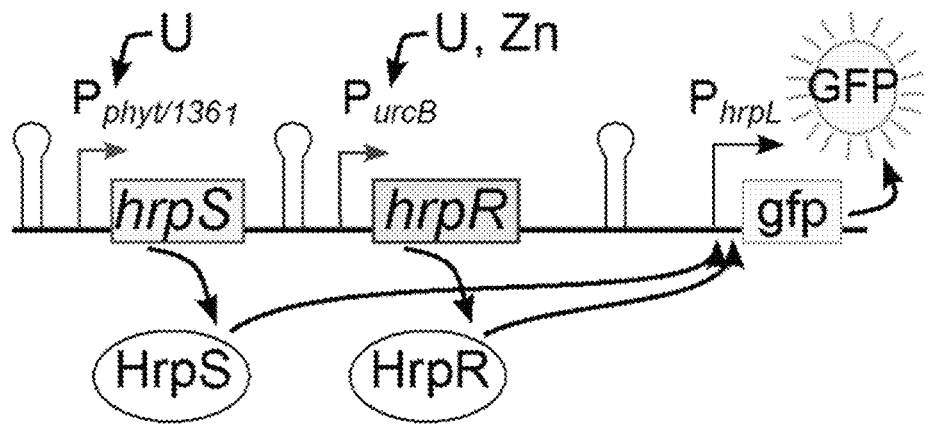
FIG. 6A and FIG. 6B show schematics of two exemplary U-sensitive genetic circuits with 'in parallel' AND gates comprising two points of U-sensing by (1) 1363/1362 two-component system (exemplified by U-sensitive transcriptional regulator direct repeat-containing promoters $P_{phyt}$ or $P_{1361}$) and (2) UzcRS two component system (exemplified by UzcRS-responsive promoter $P_{urcB}$).
Figure 6B:
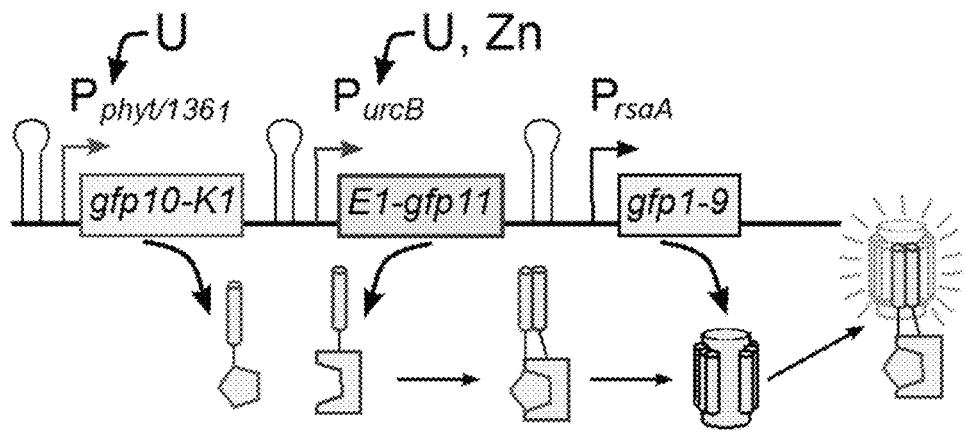
Figure 6C:
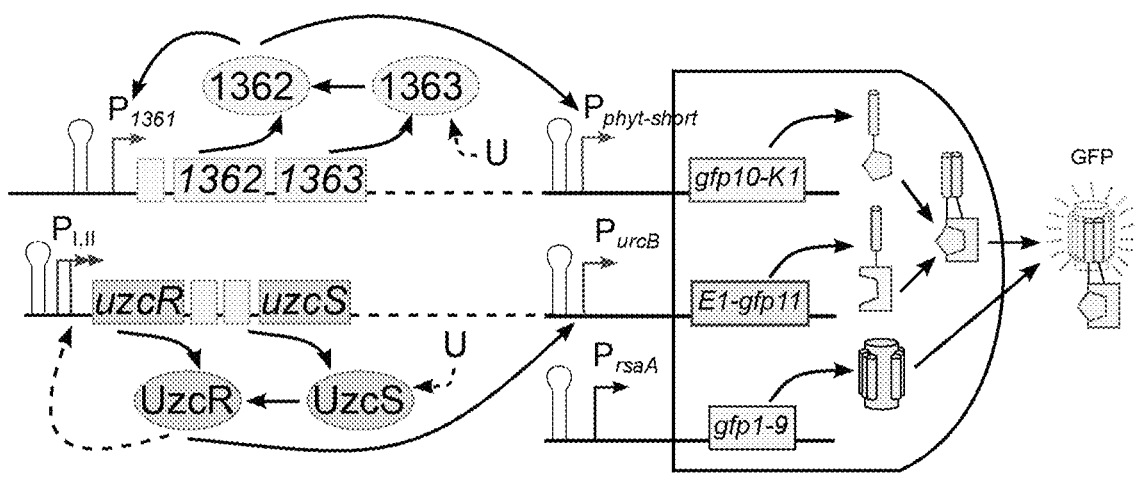
FIG. 6C shows a more detailed version of FIG. 6B, depicting how the two independent U sensing systems are integrated into the AND gate.

In some embodiments described herein, an 'in parallel' AND gate comprises an HRP AND gate. The term "HRP AND gate" as used herein refers to an AND gate system from *Pseudomonas syringae* that was developed in *E. coli* [126]. The HRP AND gate system comprises an orthogonal $\sigma^{54}$ dependent hrpR/hrpS hetero-regulation module from the hrp (hypersensitive response and pathogenicity) system for Type III secretion in *Pseudomonas syringae* [114-116], as described above. In the HRP AND gate system, both HrpS and HrpR are required for 654 dependent activation of the hrpL promoter ($P_{hrpL}$) and expression of HrpS or HrpR alone is not sufficient for transcriptional activation. In exemplary embodiments described herein, two different promoters, (1) a U-sensitive promoter comprising a 1362 binding site, such as a $P_{1361}$ or Pphyt, and (2) a UzcRS-regulated promoter, act as independently activated inputs to initiate the transcription of hrpR and hrpS, respectively, functioning as two independent points of U-sensing in response to their respective U-sensitive transcriptional regulators (FIG. 6 Panel A). In exemplary embodiments described herein, transcription of the output hrpL promoter is activated only when both proteins HrpR and HrpS bind the upstream activator sequence to remodel a closed $G_{54}$-RNAP-hrpL transcription complex to an open one through ATP hydrolysis [126]. In an exemplary HRP AND gate described herein, the output shown is GFP reporter expression (FIG. 6 Panel A).

The performance of the HRP AND gate can be described using a Hill function for the promoter steady-state input-output response (transfer function) in the form:

$$f([I])=k(\alpha+[I]^{n1}/(k_1^{n1}+[I]^{n1})) \quad \text{Eq. (1)}$$

where [I] is the concentration of the inducer, such as bioavailable U; $K_1$ and $n_1$ are the Hill constant and coefficient, respectively, relating to the promoter-regulator/inducer interaction; k is the maximum expression level due to induction; and a is a constant relating to the basal level of the promoter due to leakage [126] and further in the form:

$$f([R],[S])=[G]/[G]_{max}=([R]/K_R)^{nR}([S]/K_S)^{nS}/((1+([R]/K_R)^{nR})(1+([S]/K_S)^{nS})) \quad \text{Eq. (2)}$$

which describes the normalized output of the AND gate as a function of the levels of the two activator proteins ([R] for HrpR, [S] for HrpS) at steady state. $[G]_{max}$ is the maximum activity observed for the output. $K_R$, $K_S$ and $n_R$, $n_S$ are the Hill constants and coefficients for HrpR and HrpS, respectively [126].

In an exemplary HRP AND gate (see Example 3), the expression of hrpS is placed under the control of a U-sensitive promoter comprising a 1362 binding site, such as a $P_{Phyt}$ or $P_{1361}$, while hrpR is placed under the control of $P_{urcB}$, a UzcRS-dependent promoter that has lower basal activity compared to $P_{urcA}$ [3]. In Example 3, the $P_{hrpL}$ promoter regulating gfp expression requires $P_{Phyt}/P_{1361}$ and $P_{urcB}$ to be active to generate a fluorescent signal.

In some embodiments, an 'in parallel' AND gate comprises a tripartite GFP AND gate. As described herein, in the tripartite GFP AND gate system, reporter function is based on tripartite association between two twenty amino-acids long GFP tags, GFP10 and GFP11, which are fused to interacting protein partners, in addition to a complementary GFP1-9 detector. When the interacting protein partners interact, GFP10 and GFP11 self-associate with GFP1-9 to form a functional GFP [5].

In an exemplary tripartite GFP AND gate (see Example 4), expression of a gfp10-K1 fusion gene is placed under control of a U-sensitive promoter comprising a 1362 direct repeat binding site, such as a $P_{phyt}$ or $P_{1361}$, expression of a E1-gfp11 fusion gene is placed under control of a UzcRS-responsive promoter, such as $P_{urcB}$, and expression of gfp1-9 is placed under control of a non-U-responsive, strong, constitutively active promoter, $P_{rsaA}$. Thus, in Example 4, assembly and function of tripartite GFP requires both U binding and activation independently of a U-sensitive promoter comprising a 1362 binding site, such as a $P_{phyt}/P_{1361}$ and a UzcRS-responsive promoter.

In some embodiments, an 'in parallel' AND gate system comprises a bacterial two-hybrid AND gate.

In an exemplary bacterial two-hybrid AND gate (see Example 5). In some embodiments, an 'in parallel' AND gate system comprises a FRET sensor AND gate.

In some embodiments, the U-sensitive genetic circuits described herein comprise a combination of two or more 'in series' and/or 'in parallel' AND gates as described herein, wherein the two or more AND gates are connected by activating, inhibiting, binding or converting reactions.

Figure 14:
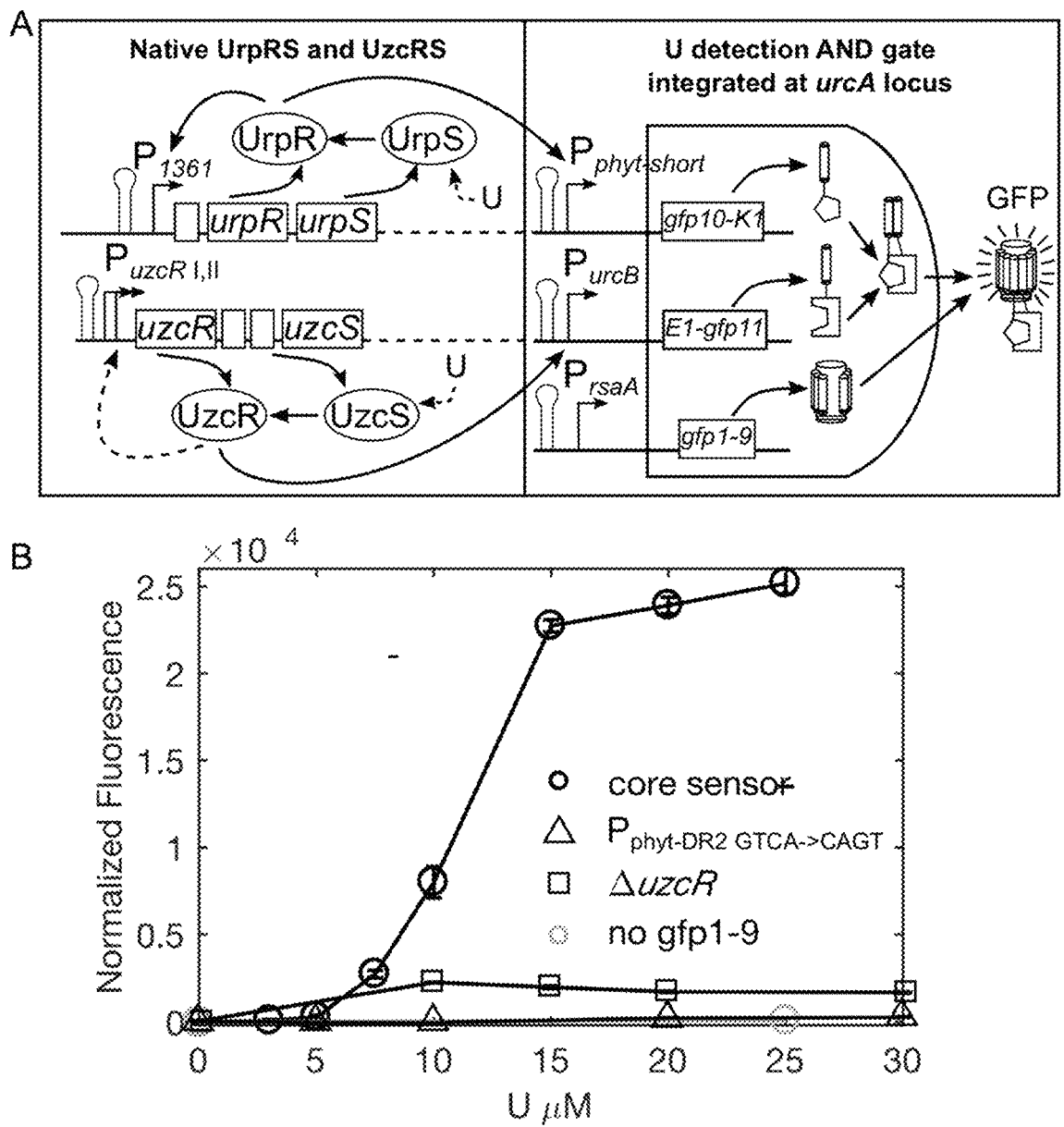
FIG. 14 shows an exemplary embodiment of a U-responsive AND gate design. Panel A shows a schematic of an example of an 'in series' AND gate combined with an 'in parallel' AND gate in a U sensitive genetic circuit. In the exemplary combined circuit, the $P_{urcB}$ promoter in the exemplary 'in parallel' tripartite GFP AND gate is activated by UzcR, and expression of UzcR and UzcS is under transcriptional regulation of $P_{phyt}$ in an 'in series' AND gate. Grey arrows depict regulator modifications made to the base 'in parallel' AND gate to generate the combined 'in series', 'in parallel' AND gate circuit. In the tripartite GFP system, gfp10 subunit is placed under the control of $P_{phyt-short}$, gfp11 is placed under the control of $P_{urcB}$, and gfp1-9 is placed under the control of the *Caulobacter* S layer promoter, $P_{rsaA}$, which is a strong, constitutive promoter. [4] This genetic circuit was integrated into the chromosomal urcA locus and integrates regulatory input from the native, autoregulatory UzcRS and UrpRS TCS, depicted in the gray box. Panel B shows the fluorescence output profile of the core sensor and control variants lacking critical regulatory components over a range of U concentrations. Error bars represent the average of biological triplicates.

For example, FIG. 14 shows an exemplary combination of an 'in series' AND gate and an 'in parallel' AND gate (see Example 8). In this exemplary embodiment, the exemplary 'in series' AND gate shown in FIG. 4 Panel C and the exemplary 'in parallel' tripartite GFP AND gate shown in FIG. 6 Panel B are connected, such that the $P_{phyt}$-regulated UzcR no longer activates expression of GFP regulated by $P_{1968}$ as in FIG. 4 Panel C, but rather activates expression of E1-gfp11 regulated by $P_{urcB}$ within the tripartite GFP 'in parallel' AND gate. As a result, in the exemplary combined configuration shown in FIG. 14 is that activation of $P_{urcB}$ in the 'in parallel' tripartite GFP AND gate is restricted to U-selective activation of UzcR and UzcS expression by $P_{phyt}$ in the 'in series' AND gate, whereas in the 'in parallel' tripartite GFP AND gate shown in FIG. 6 Panel B $P_{urcB}$ can be activated by U, Zn or Cu. Thus, an advantage of the combination of these exemplary AND gates is increased selectivity for U.

In particular in some embodiments, circuit contains the native uzcRS genes placed under the control of the Pphyt promoter—the chromosomal P1 and P2 promoters are swapped with Pphyt as described herein. This could be done by deleting uzcRS and using a plasmid-based system to reintroduce these genes into the circuit. In those embodiments, the circuit leverages the improved selectivity of U over Zn observed in the sensor depicted in FIG. 4 Panel C—A U/Zn ratio of 5.5.

In any one of the above embodiments a Fluoride sensing riboswitch can be included within any one of the genetic molecular components of any one of the U-sensitive genetic circuit. The fluoride riboswitch will not bind F and transcription will be prematurely terminated. In the presence of bioavailable F, the fluoride riboswitch will bind F and transcription initiation will occur, resulting in activation of the reportable element of the circuit and in providing the single output of the circuit. In the addition or in the alternative, a F sensing riboswitch can be included within a separate F-sensing reportable genetic molecular component and/or F-sensing genetic circuit. In those embodiments in the presence of bioavailable F, the fluoride riboswitch will bind F and transcription initiation will occur, resulting in activation of the separate F-sensing reportable genetic molecular component and/or the separate F-sensing genetic circuit to provide the F-sensing output of the dual output configuration of the $UO_2F_2$ biosensors herein described.

As would be understood by persons skilled in the art, in order for the $UO_2F_2$-biosensor s described herein to operate in response to bioavailable U, the U-sensitive and/or F-sensitive genetic circuits described herein comprise one or more genetic molecular components that are orthogonal to the proteobacteria cell of the $UO_2F_2$ biosensor.

In some embodiments, the circuit components of U-sensing and/or F-sensing circuit herein described are stably integrated in the host. In some embodiments, the 'in series' AND gate described herein was constructed using the native uzcR and uzcS genes. In some of these embodiments the chromosomal P1 and P2 promoters have been replaced with Pphyt.

Figure 13:
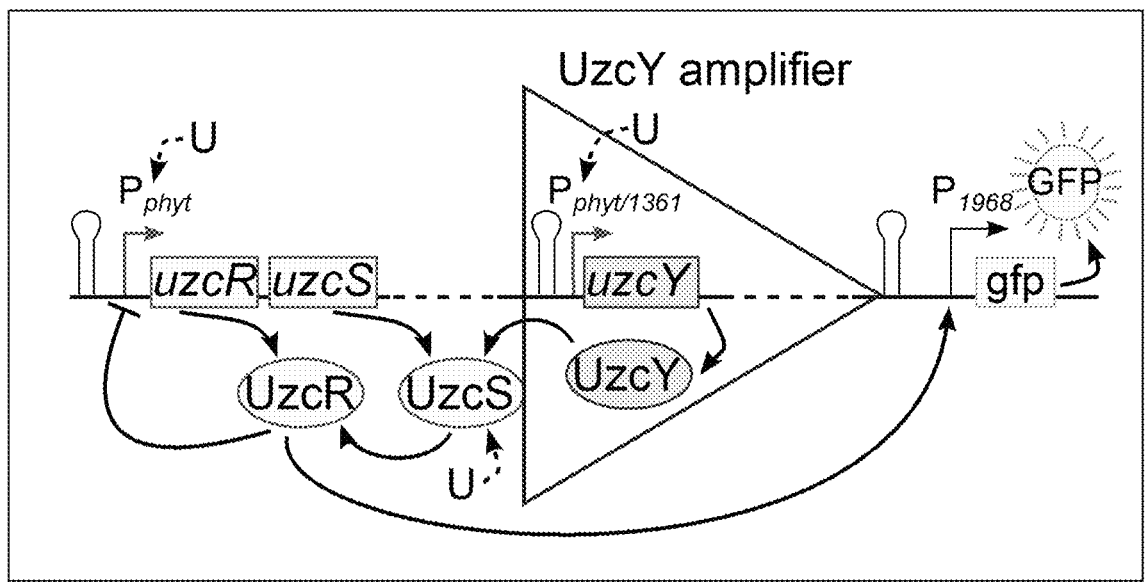
FIG. 13 shows a schematic of an exemplary signal amplifier module incorporated within a U sensing circuit. The signal amplifier uzcY is placed under the control of the U-specific promoters $P_{phyt}/P_{1361}$ such that signal amplification is restricted to conditions of U exposure.

In some embodiments of the U-sensitive genetic molecular components and/or U-sensitive genetic circuit herein described comprising UzcR binding and a UzcRS TCS, the U-sensing genetic molecular component and/or U-sensing genetic circuit can further comprise an amplifier genetic molecular component comprising a U-sensitive promoter and/or a controllable promoter operatively connected to the UzcY and/or UzcZ in a configuration wherein the U-sensitive promoter and/or a controllable promoter directly initiates expression of the amplifier molecular component (see FIG. 13).

The term "UzcY" as used herein indicates a protein having the amino acid sequence:

(SEQ ID NO: 33)
MTRDQDTLRMLAEVEAANADLARRAKAPLWYHPALGLLVGALIAVQGQPT

SILLVFYAAYIAGLALLVRAYKRHTGLWVSGYRAGRTRWVALGLATLTMI

GGVIAVWLLRERGLTAAPLIFGAIVAVIVTVGGFVWEAAFRADLRDGRPL or a sequence that when aligned with sequence SEQ ID NO: 33 has a BLAST score has a BLAST score greater than 50 and less than 100, or preferably greater than 100 and less than 200, or more preferably a BLAST score greater than 200 and a homology with SEQ ID NO: 33 less than 100%, or even more preferably BLAST score of 289 and an homology of 100% with SEQ ID NO: 33.

The term "UzcZ" as used herein indicates a protein having the amino acid sequence:

(SEQ ID NO: 34)
MRRGSQPMHAPISATERSTIAQIGGRNAPIGALRAFVTLLVIAHHTVLAY

TPNPPPIGDFSQAPYLWQAFPVRDPQKFELFGLLTLINDLFFMSLMFFIS

GLFVADGLRAKGNGGLLSGRAARLGVPFVLAAGLLAPLAYFPAWLQAGGD

VSIAGFASAWLDLPSWPSGPAWFLWVLLAFGAIVTLLNLIAPGVIDALGR

LVRGADRKPGLFFLGLVIASAVAYIPMSATFTFMHWTQLGPFTVQTSRVV

HYFVYFLAGVAVGAAGVGQGLTDSEGKLAKRWWAWQAAPILPVVGVIAVI

IMAFSPKPPPRVALDIGGGVMFALACATLSFAALATFLRFVKKTGPVAAS

LQANAYGMYLTHYVFTTWLAWLLLPQAWGGLAKGAAVFVGATLLSWILTM

ALRRLPLLGRIL or a sequence that when aligned with sequence SEQ ID NO: 34 has a BLAST score has a BLAST score greater than 200 and less than 475, or preferably greater than 470 and less than 700, or more preferably a BLAST score greater than 700 and a homology with SEQ ID NO: 34 less than 100%, or even more preferably BLAST score of 801 and an homology of 100% with SEQ ID NO: 34.

In particular, in U-biosensors herein described comprising UzcR binding and a UzcRS TCS, the amplifier molecular component acts as a 'genetic signal amplifier' configured to increase an output, e.g. expression or levels of a reportable molecular component and/or a U-neutralizing molecular component at a given bioavailable U concentration, thus enabling more sensitive detection and reporting and/or neutralizing of bioavailable U at lower concentrations.

Genes encoding activators UzcY and UczZ herein described are herein also indicated as uzcY gene or uzcY and uczZ gene or uczZ, respectively as will be understood by a skilled person.

In particular, in some embodiments the U-sensitive genetic circuit comprises one or more amplifier genetic molecular components comprising uzcY gene CCNA_03497 encoding *Caulobacter crescentus* $N_{100}$ UzcY (SEQ ID NO: 33) and/or uzcZ gene CCNA_02291 encoding for *Caulobacter crescentus* $N_{100}$ UzcZ (SEQ ID NO: 34) under a promoter that can be either a constitutively active promoter or an inducible promoter. In preferred embodiments, the promoter is constitutively active.

In some embodiments the uzcY and/or uzcZ gene are under the transcriptional regulation of a promoter comprising a regulator direct repeat, such as exemplary promoters $P_{phyt}$ or $P_{1361}$. In an exemplary embodiment described herein, the U-sensitive genetic circuit comprises CCNA_03497 placed under the control of $P_{phyt}$ so that U exposure enhances the sensitivity of UzcRS for U (see Example 7).

In some embodiments of the U-sensitive genetic molecular components, and/or U-sensitive genetic circuit herein described comprising UzcR binding and a UzcRS TCS, the bacteria are capable of natively expressing endogenous MarR family repressors such as marR1 and/or marR2 genes.

The term "MarR1" as used herein indicates a protein of amino acid sequence:

(SEQ ID NO: 35)
MSAALDPVIHAPNRLQMCCMLAAVDTIDFATVREALDVSESVLSKHVKTL

EEAGYVKVKKAASDGRQRTWLSLSKPGREALKGHLAALKAMMAGVPEA or a sequence that when aligned with sequence SEQ ID NO: 35 has a BLAST score greater than 65 and less than 100, or preferably greater than 100 and less than 150, or more preferably a BLAST score greater than 150 and a homology with SEQ ID NO: 35 less than 100%, or even more preferably BLAST score of 199 and a homology of 100% with SEQ ID NO: 35.

The term "MarR2" as used herein indicates a protein having amino acid sequence:

(SEQ ID NO: 36)
MAPRFDISGLDDVIHGRVRLGIVAYLASAEVADFTELKDVLEVTQGNLSI

HLRKLEEAGYVSIDKSFVGRKPLTRVRLTDTGRAAFSSYLRAMGQLVEQA

GGG or a sequence that when aligned with sequence SEQ ID NO: 36 has a BLAST score has a BLAST score greater than 75 and less than 100, or preferably greater than 100 and less than 150, or more preferably a BLAST score greater than 150 and a homology with SEQ ID NO: 36 less than 100%, or even more preferably BLAST score of 206 and a homology of 100% with SEQ ID NO: 36.

Figure 12:
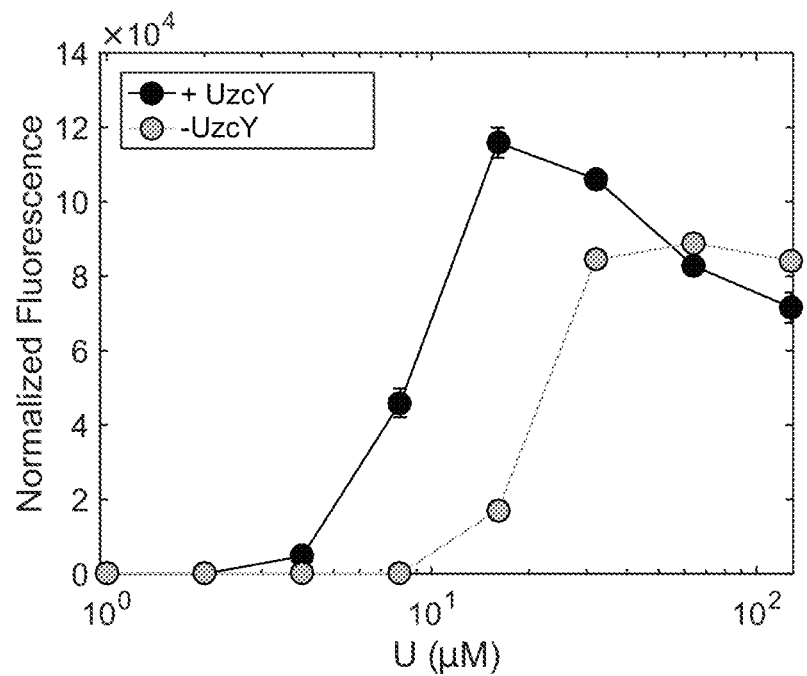
FIG. 12 shows a graph reporting data showing activity of an exemplary native signal amplifier module for UzcRS. The graph shows increase in fluorescence at various U concentrations in a CCNA_03499 mutant (+ UzcY) or in wild type cells (− UzcY), relative to conditions in absence of metal. Fluorescence was normalized to cell density ($OD_{600}$).
Figure 26:
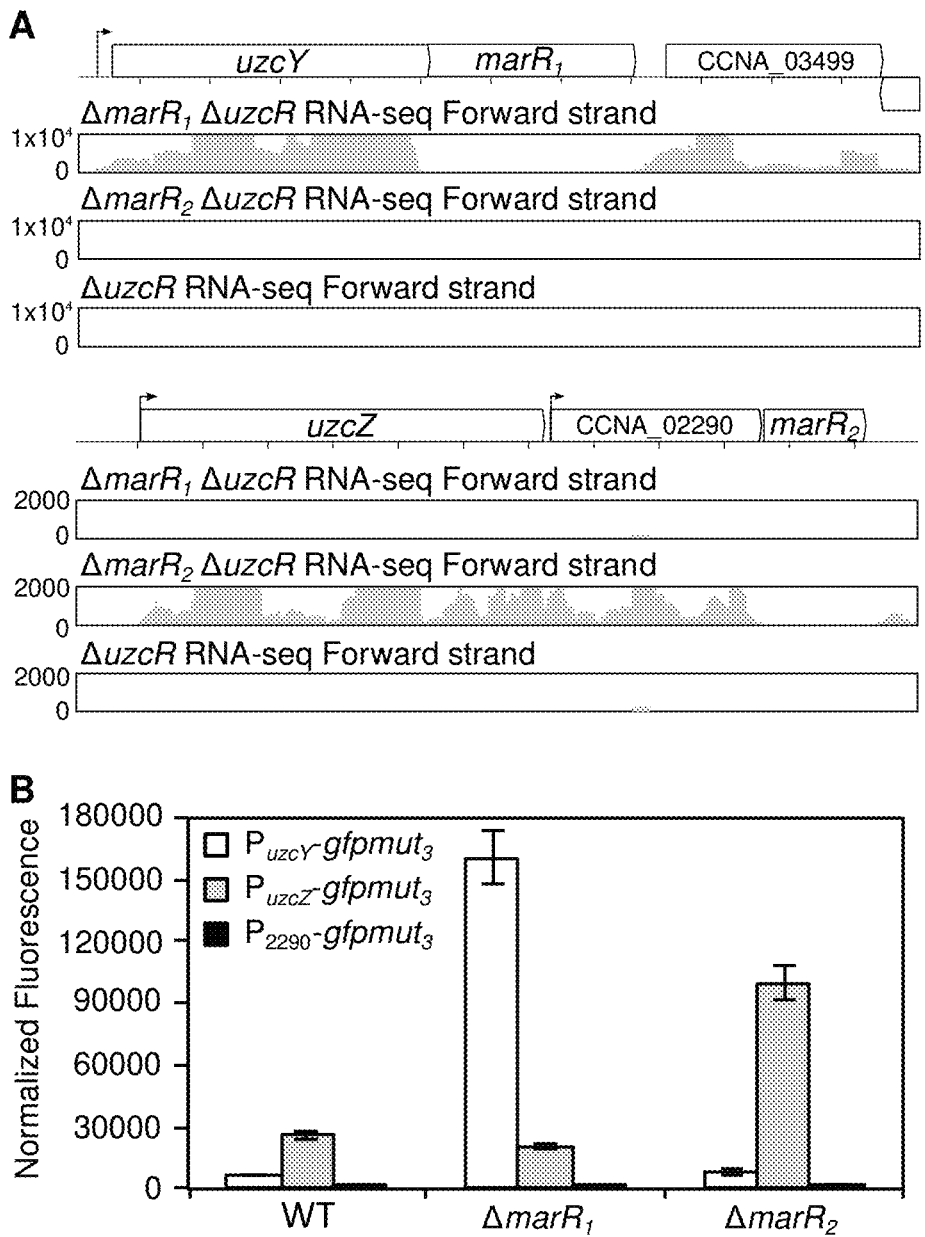
FIG. 26 shows exemplary MarR regulators repressing expression of the membrane proteins UzcY and UzcZ according to some embodiments herein described. Panel (A): Operon diagram and RNA-seq expression profile of the autoregulatory $marR_1$ (top) and $marR_2$ (bottom) operons. The RNA-seq data for a $ΔmarR_1$ ΔuzcR (top), $ΔmarR_2$ ΔuzcR (middle) and ΔuzcR (bottom) is depicted for each operon. The black arrows depict the location of the $P_{urcY}$ and $P_{uzcZ}$ transcription start sites. Panel (B): Effect of $marR_1$ and $marR_2$ deletions on the expression of the uzcY, uzcZ and CCNA_02290 promoters. The Fluorescence of promoter-gfp fusions was quantified at mid-exponential phase and normalized to the $OD_{600}$. Error bars represent the standard deviation of biological triplicates.

In preferred embodiments, of $UO_2F_2$-biosensors herein described comprising UzcR binding and a UzcRS TCS, wherein the host is capable of natively expressing endogenous MarR family repressors such as marR1 and/or marR2 genes, at least one gene of the endogenous MarR family, preferably all genes of the endogenous MarR family, is knocked out to provide an amplified U-biosensor configured to provide an amplified signal following activation of the U-sensitive genetic circuit (see Example 7 and FIG. 12). In particular, by deleting MarR family repressor, uzcY expression is induced (see FIG. 26), thus leading to the stimulation of UzcS activity and causing a hypersensitive output in response to low metal concentration.

Genes encoding for repressors MarR1 and MarR2 herein described are herein also indicated as marR1 gene or MarR1 and marR2 gene or MarR2, respectively as will be understood by a skilled person.

In some embodiments, wherein the host is *Caulobacter crescentus* NA1000 the protein MarR1 and MarR2 are the protein encoded by marR1 gene CCNA_03498 found in Caulobacter crescentus NA1000 (SEQ ID NO: 35) and protein encoded by marR2 gene CCNA_02289 found in Caulobacter crescentus NA1000 (SEQ ID NO: 36) respectively.

In some embodiments of the U-sensitive genetic molecular components and/or U-sensitive genetic circuit herein described comprising UzcR binding and a UzcRS TCS, the bacteria are capable of natively expressing an UzcRS Regulating Transporter Atpase aminoPeptidase (herein also urtAP).

In particular, UrtAP is an ATP-binding cassette transporter (ABC transporters) comprising UrtA an ATPase and UrtP a peptidase which contains 13 transmembrane domains and a C-terminal peptidase domain.

The term "UrtA" as used herein indicates a protein encoded by a gene having a protein coding region adjacent in the genome and cotranscribed with urtP, the protein having amino acid sequence:

(SEQ ID NO: 143)
MLIIENLTHVYGNGTRALDEVSLTIPRGMYGLLGPNGAGKSTLMRTIATL

QAPTSGHIRFGDIDVLKHPEELRKTLGYLPQDFGVYPRVSAYDMLDHMAV

LKGISGGKERKATVEHLLNQVNLWDVRKKAIAGFSGGMRQRFGIAQALIG

DPRLIIVDEPTAGLDPEERNRFLNLLAEIGENVVVILSTHIVEDVSDLCP

AMAIICNGAIVREGAPADLVAQLKGRIWKKIIDKAELEAAKARYKVISTR

LLAGRTVIHIESETDPGDGFTAVEGGLEDVYFSTLSSTRSRQAA or a sequence that when aligned with sequence SEQ ID NO: 143 has a BLAST score greater than 250 and less than 500, or preferably greater than 500 and less than 599, and a homology with SEQ ID NO: 143 less than 100%, or even more preferably BLAST score of 599 and a homology of 100% with SEQ ID NO: 143. The term "urtP" as used herein indicates a protein of amino acid sequence:

(SEQ ID NO: 144)
MFGKIAGFELRYQLKSPVFWVVAVIFFLMTFGAATIDQIRIGGGGNIHKN

APYAIAQTHLILAIFYMFVTTAFVANVVVRDDETGFGPILRSTRIRKFDY

LYGRFTGAFLAAAISFLVVPLAIFVGSFMPWVDPERLGPNDLNAYLFSYF

ALALPAILLTSAIFFALATVTRSMMWTYVGVIAFLVLYIIAGIALDRPEY

EKGAALWEPLGTAAFGLATKYWTASERNSLTPPLAGALLFNRVFVLVLAA

GFLALAYSLFRFQSAELSGQRKSAKKTKAAPTEAAPAASGPLPTPVFDRR

TAWAQLVVRTRLDMGQVFKSPAFFVLLFLGLANAMGALWFATEAGRYGGV

VYPVTRILLFPLLGSFGLIPIIIAIYYSGELVWREREKKTHEIIDATPVP

DWAFVAPKTLAISLVLISTLLISVVAAMLSQVFHGYFNFELEKYLLWYVL

PQALDFILLAVLAVFLQTISPHKFIGWALMVIYIVSTITFTNLGFEHKLY

NYGATTETPFSDMNGLGKFWMGAWWLRAYWTAFALVLLVLAYGLWRRGTE

SRLLPRLRRLPLRLNGGAGALMGVSLVAFAGLGGFIYVNTNVWNEYRTNI

DGEKWQAEYEKTLLPFENTPQPKIIAQTLDIDIQPHAPSLETKGSYVLEN

KTGAALKEIHVRFDRDLEVKGLSIEGARPKKTFEKFNYRIFAFDTPMAPG

EQRKMSFITLRAQRGFPNSGAETRVVDNGTFVNNLEIAPILGMSRDGLLT

DRAKRRKYGLPPEQRMAKLGDVSSMQFNGLRKDADFIQSDITVTTVADQT

PIAPGYKVSDSVRNGRRTARFVTEAPIMPFVSIQSARYKVAEETYKGVQL

AVYYDPQHAWNIDRMKTSMKRSLDYMGTNFSPYQFRQLRYQEFPDYAQFA

QSFANTIPWSEGMFFISDYRDPTKIDMVTYVGAHEIGHQWWAHQVIGANQ

QGGAMLSETFAQYSALMVMKHTYGEDQIRKFLKFELDSYLRARGGDVIDE

QPLYKVENQPYIYYRKGSLVMYRLQDQIGEEAVNRALRKLIADHAFKGAP

YPTTLDFMAALRAEAPADKQALITDLFEKITLYDLKTKSAAVKKRADGKF

DVTVVVEAQKKYADGKGKETVAALNETMEIGLFTAKPGDKGFVAKNVVLY

QRRPIRSGENTFTFIVDKAPTFAGIDPYNTVIDRNGDDNTVKVGG or a sequence that when aligned with sequence SEQ ID NO: 144 has a BLAST score greater than 600 and less than 800, or preferably greater than 800 and less than 1200 or greater than 1000 and less than 1200, or more preferably a BLAST score greater than 1200 and less than 2000, or more preferably a BLAST score equal to or higher than 2000 or even more preferably BLAST score of 2436 and a homology of 100% with UrtP sequence from Caulobacter crescentus NA1000 or Caulobacter crescentus CB15 and in particular with SEQ ID NO: 144.

In preferred embodiments, of $UO_2F_2$-biosensors herein described comprising UzcR binding and a UzcRS TCS, wherein the host is capable of natively expressing endogenous urtAP, at least one gene of the endogenous urtAP, preferably all genes of the endogenous urtAP, is knocked out to provide an amplified U-biosensor configured to provide an amplified signal following activation of the U-sensitive genetic circuit. In particular, by deleting the endogenous urtAP, it is expected that the UzcRS TCS will be stimulated and exhibit greater uranium sensitivity.

Genes encoding for UrtA and UrtP herein described are herein also indicated as urtA gene or UrtA and urtP gene or UrtP, respectively as will be understood by a skilled person.

Detection of a host capable of expressing endogenous urtAP can be performed by detecting UrtP or urtP as urtA is more conserved as will be understood by a skilled person.

In some embodiments, wherein the host is Caulobacter crescentus NA1000 the protein UrtA and UrtP are the protein encoded by UrtA gene CCNA_03681 found in Caulobacter crescentus NA1000 (SEQ ID NO: 143) and protein encoded by UrtP gene CCNA_03680 found in Caulobacter crescentus NA1000 (SEQ ID NO: 144) respectively.

Additional features of the $UO_2F_2$ which are derived from whole cell biosensors in the sectors of heavy metal detection in aqueous systems [127-130], pathogen detection and eradication [131], organic pollutant detection [132], and standoff detection of landmines [133, 134] comprise genetic modification to boost sensor performance (sensitivity, detection limit, etc. [135, 136]), a microfluidic chemostat platform that maintains cell viability and sensor function for at least a week [137], optical transducer components that convert cell fluorescence into an electronic signal that is transmitted on a mobile phone network [138], and an automated water-sampling feature [138].

Additional exemplary features comprise standoff detection functions [133, 134] and couples sensor cells, which are encapsulated within a polymeric matrix and placed in proximity of a suspicious region, with a novel optical scanning system to enable remote detection at a distance of up to 50 meters in optically noisy aqueous and soil environments [133, 134].

In some embodiments herein described, a method to provide a U biosensor is provided, the method comprising genetically engineering a bacterial cell capable of natively and/or heterologously expressing a histidine kinase 1363 and/or histidine kinase UzcS, and U sensitive response regulator 1362 and/or U sensitive response regulator UzcR in combination with a heterologous F-sensing riboswitch, the genetically engineering performed by introducing into the one or more U-sensing genetic molecular components configured to report and/or neutralize U herein described, an F-sensitive riboswitch within the one or more U-sensing genetic molecular components configured to report U, an F-sensitive riboswitch within an F-sensing reportable genetic molecular component;

one or more genetic molecular components of an F sensitive genetic circuit described herein, and/or one or more genetic molecular components of the U-sensitive F-sensitive genetic circuits described herein, to provide a $UO_2F_2$-biosensor according to any one of the embodiments herein described as will be understood by a skilled person upon reading of the present disclosure, and optionally operatively connecting one or more of the U biosensors to an electronic signal transducer adapted to convert a U biosensor reportable molecular component output into an electronic output.

Polynucleotide and protein molecules as described herein can be genetically engineered using recombinant techniques known to those of ordinary skill in the art. In particular, in some embodiments, Fluoride sensing riboswitch, a promoter comprising the U-sensitive 1362 binding site and/or an UzcR binding site can be genetically engineered by introducing into a polynucleotide comprising a promoter DNA sequence a polynucleotide comprising the Fluoride sensing riboswitch, the U-sensitive 1362 binding site and/or a UzcR binding site, as described herein. In other embodiments, a Fluoride sensing riboswitch, a U-sensitive promoter comprising the 1362 binding site and/or a UzcR binding site can be genetically engineered by de novo designing a synthetic promoter DNA sequence comprising the Fluoride sensing riboswitch, the 1362 binding site and/or the UzcR binding site.

Production and manipulation of the polynucleotides described herein are within the skill in the art and can be carried out according to recombinant techniques described, for example, in Sambrook et al. 1989. *Molecular Cloning: A Laboratory Manual*, 2d ed., Cold Spring Harbor Laboratory Press, Cold Spring Harbor, N.Y. [139] and Innis et al. (eds). 1995. *PCR Strategies*, Academic Press, Inc., San Diego, [140] which are incorporated herein by reference.

It is understood that terms herein referring to nucleic acid molecules such as "polynucleotide" and "nucleotide sequence" comprise any polynucleotides such as DNA and RNA molecules and include both single-stranded and double-stranded molecules whether it is natural or synthetic in origin.

The term "polynucleotide" as used herein indicates an organic polymer composed of two or more monomers including nucleotides, or analogs thereof. The isoelectric point of a polynucleotide in the sense of the disclosure is less than 7 as will be understood by a skilled person. The term "nucleotide" refers to any of several compounds that consist of a ribose or deoxyribose sugar joined to a purine or pyrimidine base and to a phosphate group and that is the basic structural unit of nucleic acids. The term "nucleotide analog" refers respectively to a nucleotide in which one or more individual atoms have been replaced with a different atom or with a different functional group. Accordingly, the term "polynucleotide" includes nucleic acids of any length, and in particular DNA, RNA, analogs and fragments thereof. A polynucleotide of three or more nucleotides is also called "nucleotidic oligomer" or "oligonucleotide". In particular, polynucleotides in the sense of the disclosure comprise biological molecules comprising a plurality of nucleotides. Exemplary nucleic acids include deoxyribonucleic acids, ribonucleic acids, and synthetic analogues thereof, including peptide nucleic acids. Polynucleotides can typically be provided in single-stranded form or double-stranded form and in liner or circular form as will be understood by a person of ordinary skill in the art.

In some embodiments herein described, the polynucleotide is a DNA molecule that can be in a linear or circular form, and encodes one or more proteins under the control of a promoter recognizable by an enzyme such as an RNA polymerase, that is capable of transcribing the encoded DNA.

The term "protein" as used herein indicates a polypeptide with a particular secondary and tertiary structure that can interact with another molecule and in particular, with other biomolecules including other proteins, DNA, RNA, lipids, metabolites, hormones, chemokines, and/or small molecules. The term "polypeptide" as used herein indicates an organic linear, circular, or branched polymer composed of two or more amino acid monomers and/or analogs thereof. The term "polypeptide" includes amino acid polymers of any length including full-length proteins and peptides, as well as analogs and fragments thereof. A polypeptide of three or more amino acids is also called a protein oligomer, peptide, or oligopeptide. In particular, the terms "peptide" and "oligopeptide" usually indicate a polypeptide with less than 100 amino acid monomers. In particular, in a protein, the polypeptide provides the primary structure of the protein, wherein the term "primary structure" of a protein refers to the sequence of amino acids in the polypeptide chain covalently linked to form the polypeptide polymer. A protein "sequence" indicates the order of the amino acids that form the primary structure. Covalent bonds between amino acids within the primary structure can include peptide bonds or disulfide bonds, and additional bonds identifiable by a skilled person. Polypeptides in the sense of the present disclosure are usually composed of a linear chain of alpha-amino acid residues covalently linked by peptide bond or a synthetic covalent linkage. The two ends of the linear polypeptide chain encompassing the terminal residues and the adjacent segment are referred to as the carboxyl terminus (C-terminus) and the amino terminus (N-terminus) based on the nature of the free group on each extremity. Unless otherwise indicated, counting of residues in a polypeptide is performed from the N-terminal end ($NH_2$-group), which is the end where the amino group is not involved in a peptide bond to the C-terminal end (—COOH group) which is the end where a COOH group is not involved in a peptide bond. Proteins and polypeptides can be identified by x-ray crystallography, direct sequencing, immunoprecipitation, and a variety of other methods as understood by a person skilled in the art. Proteins can be provided in vitro or in vivo by several methods identifiable by a skilled person. In some instances where the proteins are synthetic proteins in at least a portion of the polymer two or more amino acid monomers and/or analogs thereof are joined through chemically-mediated condensation of an organic acid (—COOH) and an amine (—$NH_2$) to form an amide bond or a "peptide" bond.

As used herein the term "amino acid", "amino acid monomer", or "amino acid residue" refers to organic compounds composed of amine and carboxylic acid functional groups, along with a side-chain specific to each amino acid. In particular, alpha- or α-amino acid refers to organic compounds composed of amine (—NH2) and carboxylic acid (—COOH), and a side-chain specific to each amino acid connected to an alpha carbon. Different amino acids have different side chains and have distinctive characteristics, such as charge, polarity, aromaticity, reduction potential, hydrophobicity, and pKa. Amino acids can be covalently linked to form a polymer through peptide bonds by reactions between the amine group of a first amino acid and the carboxylic acid group of a second amino acid. Amino acid in the sense of the disclosure refers to any of the twenty naturally occurring amino acids, non-natural amino acids, and includes both D an L optical isomers.

In some embodiments, the sequence of a polynucleotide encoding a genetic molecular component described herein can be homologous to the polynucleotide sequence of the genetic molecular component described herein. For purposes of the present disclosure, two polynucleotide (RNA or DNA) sequences are substantially homologous when at least 80% (preferably at least 85% and most preferably at least 90%) of the nucleotides match over the defined length of the sequence using algorithms such as CLUSTAL or PHILIP. Sequences that are substantially homologous can be identified in a polynucleotide hybridization experiment under stringent conditions as is known in the art. See, for example, Sambrook et al. [139]. Sambrook et al. describe highly stringent conditions as a hybridization temperature 5-10° C. below the $T_m$ of a perfectly matched target and probe; thus, sequences that are "substantially homologous" would hybridize under such conditions. Stringency conditions can be adjusted to screen for moderately similar fragments, such as homologous sequences from distantly related organisms, to highly similar fragments, such as genes that duplicate functional enzymes from closely related organisms. Generally, stringent conditions are selected to be about 5° C. lower than the thermal melting point (Tm) for the specific sequence at a defined ionic strength and pH. However, stringent conditions encompass temperatures in the range of about 1° C. to about 20° C., depending upon the desired degree of stringency as otherwise qualified herein.

As used herein, "substantially similar" refers to polynucleotides wherein changes in one or more nucleotide bases can result in substitution of one or more amino acids, but do not affect the functional properties of the polypeptide or protein encoded by the nucleotide sequence. "Substantially similar" also refers to modifications of the nucleic acid fragments of the instant disclosure such as deletion or insertion of nucleotides that do not substantially affect the functional properties of the resulting polynucleotide or transcript. It is therefore understood that the disclosure encompasses more than the specific exemplary nucleotide or amino acid sequences and includes functional equivalents thereof. Alterations in a nucleic acid fragment that result in the production of a chemically equivalent amino acid at a given site, but do not affect the functional properties of the encoded polypeptide, are well known in the art.

Methods of alignment of sequences for comparison are well known in the art. Thus, the determination of percent identity between any two sequences can be accomplished using a mathematical algorithm. Non-limiting examples of such mathematical algorithms are the algorithm of Myers and Miller [141], the local homology algorithm of Smith et al. [142]; the homology alignment algorithm of Needleman and Wunsch [143]; the search-for-similarity-method of Pearson and Lipman [144]; the algorithm of Karlin and Altschul [145], modified as in Karlin and Altschul [146].

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters.

As used herein, "sequence homology", "homology", "sequence identity" or "identity" in the context of two nucleic acid or polypeptide sequences makes reference to the nucleotides or residues in the two sequences that are the same when aligned for maximum correspondence over a specified comparison window. When percentage of sequence identity is used in reference to proteins, it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule.

As used herein, "percentage homology" "percentage of sequence identity" means the value determined by comparing two optimally aligned sequences over a comparison window, wherein the portion of the polynucleotide sequence in the comparison window may comprise additions or deletions (gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

As used herein, "reference sequence" is a defined sequence used as a basis for sequence comparison. A reference sequence may be a subset or the entirety of a specified sequence; for example, as a part of a full-length cDNA or partial genomic DNA sequence, or the complete cDNA or gene sequence. A reference sequence can comprise, for example, a sequence identifiable a database such as GenBank and others known to those skilled in the art.

The term "substantial homology" or "substantial identity" of polynucleotide sequences means that a polynucleotide comprises a sequence that has at least 80% sequence identity, preferably at least 85%, more preferably at least 90%, most preferably at least 95% sequence identity compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial homology or identity of amino acid sequences for these purposes normally means sequence identity of at least 80%, preferably at least 85%, more preferably at least 90%, and most preferably at least 95%.

The polypeptides and proteins of the disclosure can be altered in various ways including amino acid substitutions, deletions, truncations, and insertions. Novel proteins having properties of interest can be created by combining elements and fragments of proteins of the present disclosure, as well as with other proteins. Methods for such manipulations are generally known in the art. Thus, the polynucleotides described herein comprise both the naturally occurring sequences as well as genetically engineered forms. Likewise, the proteins of the disclosure encompass naturally occurring proteins as well as variations and modified forms thereof.

It is furthermore to be understood that the polynucleotides of the present disclosure comprise both synthetic molecules and molecules obtained through recombinant DNA techniques known in the art.

The bacterial cells described herein can be genetically engineered using methods known to those skilled in the art. The polynucleotides, genetic molecular components and molecular components comprised in vectors described herein can be introduced into the cells using transformation techniques such as electroporation, heat shock, and others known to those skilled in the art and described herein. In some embodiments, the U-sensitive genetic molecular components and/or genetic molecular components of the U-sensitive genetic circuits are introduced into the organism to persist as a plasmid or integrate into the genome. In some embodiments, the cells can be engineered to chromosomally integrate a polynucleotide comprising one or more U-sensitive genetic molecular components and/or genetic molecular components comprised in the U-sensitive genetic circuits described herein, using methods such as sacB counterselection procedure [147]. For example, in some embodiments described herein, the U-sensitive genetic molecular components or genetic circuit components are inserted into the *Caulobacter* chromosome (see Examples). In some exemplary embodiments, a custom designed low copy vector, such as with a pBBR1 oriV origin and a cat (chloramphenicol acetyltransferase) gene can be used for reporter expression or to introduce the signal amplifier gene (CCNA_03497) (see Examples).

In embodiments herein described, a system is provided. The system comprises a plurality of proteobacterial cells and one or more vectors comprising one or more U-sensitive genetic molecular components and/or one or more genetic molecular components of a U-sensitive genetic circuit. The one or more vectors are configured to introduce one or more U-sensitive genetic molecular components and/or one or more genetic molecular components of a U-sensitive genetic circuit into an alphaproteobacterial cell.

As understood by those skilled in the art, vectors comprising a U-sensitive genetic molecular components or genetic molecular components such as promoters or RNA- or protein-coding genes described herein or fragments thereof can be engineered using techniques such as In-Fusion cloning and other methods identifiable by those skilled in the art, to generate vectors suitable for genetically engineering the proteobacterial cells described herein. Polynucleotides encoding genetic molecular components such as promoters and genes encoding RNA and proteins described herein can be isolated from genomic DNA or cDNA comprising the polynucleotides of interest, such as polynucleotides isolated from organisms such as *Caulobacter* or other Caulobacteridae, using standard Polymerase Chain Reaction (PCR)-based methods known in the art. Plasmids comprising reporter genes and/or U-neutralizing genes described herein are commercially available from vendors such as Thermo-Fisher and Clontech, and other sources such as Addgene, among others known to those skilled in the art.

Polynucleotides can also be designed and synthesized de novo, such as using gBlock synthesis (IDT Technologies) as described herein.

In embodiments herein described, a composition is provided. The composition comprises one or more $UO_2F_2$-biosensor or vectors herein described together with a suitable vehicle.

The term "vehicle" as used herein indicates any of various media acting usually as solvents, carriers, binders or diluents for the one or more U-sensitive genetic molecular components, vectors, or cells herein described that are comprised in the composition as an active ingredient. In particular, the composition including the one or more U-sensitive genetic molecular components, vectors, or cells herein described can be used in one of the methods or systems herein described.

In embodiments herein described, a system comprising an electronic signal transducer adapted to convert a $UO_2F_2$-biosensor reportable molecular component output into an electronic output is provided. The system comprises an electronic signal transducer and one or more U biosensors herein described operatively connected to the electronic signal transducer. In some embodiments, the system comprises an electronic signal transducer and one or more U biosensors herein described comprised in a composition together with a suitable vehicle.

The term "electronic signal transducer" as used herein refers to an electronic device typically comprising a biorecognition component, a biotransducer component, and an electronic system which can comprise a signal amplifier, processor, data display, and data communicator. Transducers and electronics can be combined, such as in CMOS-based microsensor systems [148].

Figure 41:
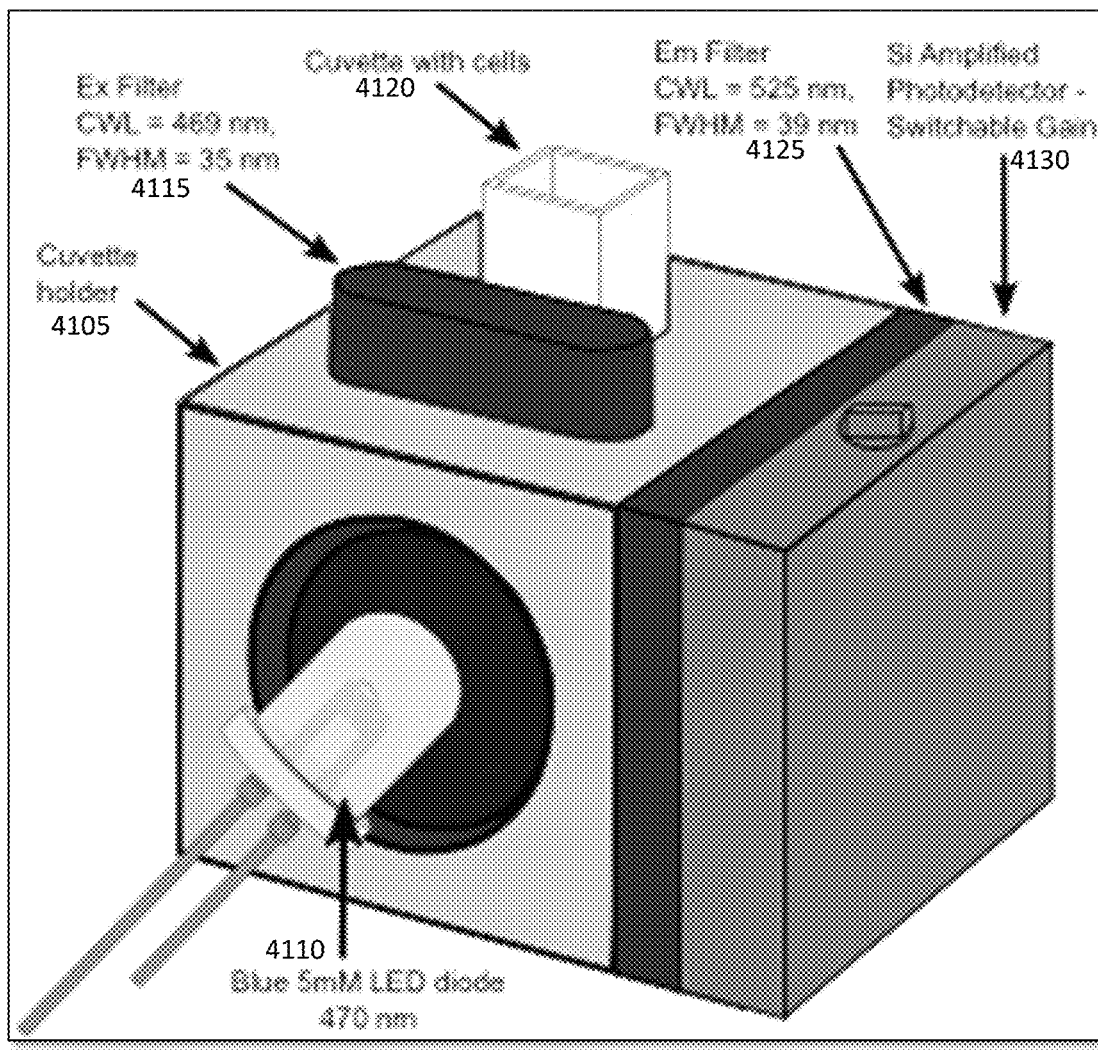
FIG. 41 shows a schematic illustration of an exemplary transducer device configured to convert an optical signal from a biosensor herein described into an electrical current using inexpensive, commercially available components (e.g., a blue LED for excitation, optical filters configured for excitation/emission of GFP, and a photodiode for detection).
Figure 42:
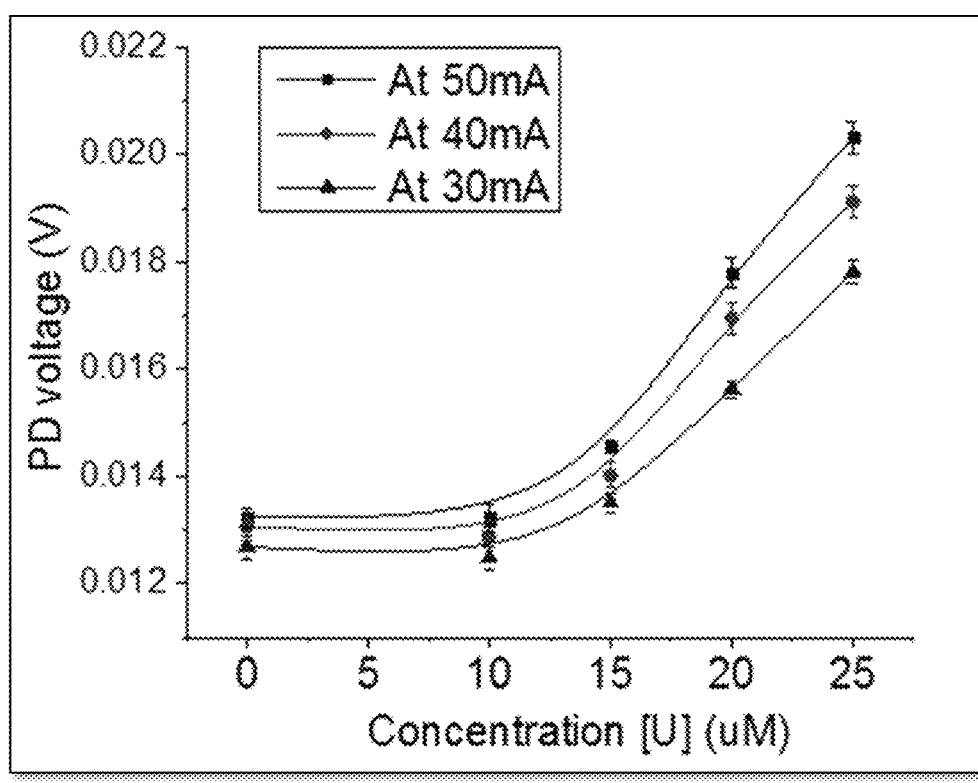
FIG. 42 shows the output voltage as a function of U concentration at three different currents using the exemplary transducer device depicted in FIG. 41. Measurements were taken two hours after uranium exposure.

As shown in FIG. 41, the transducer can be exemplarily fashioned with a blue LED (light emitting diode) (ex. 5 mM, emitting excitation light centered at 470 nm wavelength) 4110 that shines excitation light into a cuvette holder 4105. A curvette holder is a containing device for the filters and curvette, opaque so that the only light in is from the LED and the only light striking the photodetector is the filtered emission light). The blue light passes through an excitation filter (ex filter) 4115 with a center wavelength (CWL) at 469 nm (blue) and a full width at half maximum of 35 nm (narrow bandwidth). This causes a narrow spectrum of excitation light to hit upon the sample in the cuvette 4120. The cuvette is a transparent container for the sample (cells). The emitted light (emission light) from the sample, caused by excitation from the excitation light, passes through an emission filter (em filter) 4125 that has a CWL of 525 nm and a FWHM of 39 nm (a narrow bandwidth of green light). This emission light is read by a silicon amplified photodetector 4130 (with switchable gain for sensitivity control), turning the emission light into an electrical signal for analysis. In some embodiments, the recognition component, often called a bioreceptor, can use biomolecules from organisms or receptors modeled after biological systems to interact with the reportable molecular component output comprising a target analyte of interest. This interaction is measured by the biotransducer which outputs a measurable signal proportional to the presence of the target analyte in the sample. A biotransducer is the recognition-transduction component of the device. In some embodiments, it can comprise a bio-recognition layer and a physicochemical transducer, which acting together converts a biochemical signal to an electronic or optical signal. The bio-recognition layer typically can contain an enzyme or another binding protein such as antibody. For example, polynucleotides, sub-cellular fragments such as organelles (e.g. mitochondria) and receptor carrying fragments (e.g. cell wall), single whole cells, or a plurality of cells optionally on synthetic scaffolds, can also comprise the bio-recognition layer. The physicochemical transducer is typically in contact with the recognition layer. In some embodiments, as a result of the presence and biochemical action of the target analyte of interest, a physico-chemical change is produced within the biorecognition layer that is measured by the physicochemical transducer producing a signal that is proportionate to the concentration of the analyte. The physicochemical transducer can be electrochemical, optical, electronic, gravimetric, pyroelectric or piezoelectric, as understood by those skilled in the art.

In some embodiments, a quantitative, field-portable $UO_2F_2$-biosensor system comprises one or more $UO_2F_2$-biosensors described herein coupled with an electronic signal transducer to convert the cellular output reportable molecular component signal (e.g., fluorescence) into an electronic output signal. In some embodiments, one or more $UO_2F_2$-biosensors described herein are coupled in conjunction with established, inexpensive, commercially available transducer devices known to those skilled in the art, using one of several immobilization methods such as those utilizing carbon nanotubes or nanoparticles to adhere a $UO_2F_2$-biosensor host organism cells to the transducer. In particular embodiments, wherein the $UO_2F_2$-biosensor host organism is $C.\ crescentus$, the holdfast organelle that facilitates irreversible adhesion to surfaces can be used to couple the cells to the electronic signal transducer, eliminating the need for exogenous immobilization substrates.

In embodiments herein described, a method of detecting and reporting and/or neutralizing bioavailable $UO_2F_2$ is provided. The method comprises:

contacting one or more $UO_2F_2$ biosensors, or a system comprising an electronic transducer operatively connected to one or more $UO_2F_2$ biosensors, with a target environment comprising one or more target ranges of bioavailable U concentration and bioavailable F for a time and under conditions to detect and report and/or neutralize bioavailable $UO_2F_2$ in the target environment.

In some embodiments, a method to detect bioavailable $UO_2F_2$ with an F-sensing and a U-sensing genetic reportable molecular component and/or with a U sensing and/or F-sensing genetic circuit genetic including a fluorescent label such as GFP is with a fluorometer to quantify GFP or other fluorophore's fluorescence. This can be accomplished with high sensitivity in the laboratory using a microplate reader or in the field using a mini-fluorometer. In some of those embodiments, the method can comprise adding an environmental sample to a 96-well plate or cuvette containing a U-biosensor herein described.

The term "target environment" as used herein indicates the aggregate of components and related conditions wherein a U biosensor can be operated.

In some embodiments, the target environment comprises a sample obtained from a field site. In some embodiments, the sample is provided by means of an operator, such as a human or a machine, to the host organism optionally operatively connected to the electronic transducer. In other embodiments, the sample is provided, in absence of an operator, to the host organism optionally operatively connected to the electronic transducer. In some embodiments, the host organism, optionally operatively connected to the electronic transducer, can be in situ in a field site comprising the target environment.

In an exemplary embodiment, wherein the host is $Caulobacter\ crescentus$ NA1000 the biosensor is expected to work within a pH range of 6-8, temperature range of ~RT–~37 C. Additional growth nutrients other than inorganic phosphate can be added. In some embodiments, the host can be $Caulobacter\ crescentus$ OR37 strain isolated from the Oak Ridge Field site as an environmentally robust host: including a greater pH, heavy metal, and U tolerance with respect to $Caulobacter\ crescentus$ NA1000.

In some embodiments, the reporting of bioavailable $UO_2F_2$ can be observed directly, such as by visualizing the output of a reportable molecular component, such as fluorescence of a reportable molecular component, e.g., GFP, wherein the expression and/or function of the reportable molecular component is activated by the $UO_2F_2$ biosensor. In some embodiments, the reporting of bioavailable $UO_2F_2$ can be observed indirectly and/or remotely, such as through transduction of reportable molecular component output into an electronic output, which can be quantified by a computer, and which can optionally be communicated to a location at a distance from the target environment by a data communicator, either through wired or wireless communication.

Therefore, in several embodiments $UO_2F_2$ biosensors herein described provide selective and sensitive detection and reporting of $UO_2F_2$ which is a bioavailable product of environmental decomposition of UF6, a toxic form of U.

In several embodiments, the $UO_2F_2$ biosensors, and related U-sensitive F-sensitive genetic molecular components, genetic circuits, compositions, methods and systems described herein provide a cost-effective, selective, sensitive, portable, easy to use, high-throughput measurement of bioavailable U, with little or no sample preparation required.

Additionally, in some embodiments $UO_2F_2$ biosensors described herein can be used in the construction of consolidated bioremediators comprising bacterial systems that possess all the necessary components for deployment in environmental cleanup efforts. Applications of the U biosensors described herein comprise uses in biodefense (e.g., to be used for non-proliferation purposes), environmental monitoring, and mining (for toxicology and safety concerns), among other uses identifiable by those skilled in the art.

EXAMPLES

The U biosensors, and related U-sensitive genetic molecular components, genetic circuits, compositions, methods and systems herein disclosed are further illustrated in the following examples, which are provided by way of illustration and are not intended to be limiting.

In particular, the following examples illustrate exemplary methods and protocols for providing and using U biosensors, and related U-sensitive genetic molecular components, genetic circuits, compositions, methods and systems. A person skilled in the art will appreciate the applicability and the necessary modifications to adapt the features described in detail in the present section, to additional U biosensors, and related U-sensitive genetic molecular components, genetic circuits, compositions, methods and systems according to embodiments of the present disclosure.

The following methods were used:

Bacterial strains, media, and materials. All strains were derived from wild type $C.\ crescentus$ strain NA1000 (ATCC 19089) and listed in Table 2.

TABLE 2

Strain and Plasmid Table

| Strain or plasmid | Description | Source or reference |
|---|---|---|
| Strains: | | |
| NA1000 | Wild-type C. crescentus, a derivative of CB15 capable of being synchronized | [149] |
| JOE2321 | C. crescentus CB15N ΔCC_1634 | [150] |
| DMP912 | NA1000 ΔCCNA_01362 (urpR) | Present Disclosure |
| DMP913 | NA1000 ΔCCNA_01363 (urpS) | Present Disclosure |
| DMP470 | JOE2321 $P_{phyt}$-lacZ | Present Disclosure |
| DMP899 | DMP470 CCNA_01362::tn5 (1478156) | Present Disclosure |
| DMP898 | DMP470 CCNA_01362::tn5 (1478165) | Present Disclosure |
| DMP900 | DMP470 CCNA_01362::tn5 (1479640) | Present Disclosure |
| DMP901 | DMP470 CCNA_01362::tn5 (1479738) | Present Disclosure |
| DMP791 | $P_{phyt}$-gfp10_m2_K1, $P_{urcB}$-E1_gfp11_m4, $P_{rsaA}$-gfp1-9 | Present Disclosure |
| | NA1000 ΔuzcR | [151] |
| DMP213 | NA1000 ΔuzcS | [3] |
| DMP683 | NA1000 $P_{phyt}$-gfp10_m2_K1, $P_{urcB}$_E1_gfp11_m4, $P_{xyl}$-gfp1-9 | Present Disclosure |
| DMP804 | NA1000 $P_{phyt}$-gfp10_m2_K1, $P_{urcB}$_E1_gfp11_m4, $P_{rsaA}$-gfp1-9 | Present Disclosure |
| DMP895 | NA1000 $P_{phyt-short}$-gfp10_m2_K1, $P_{urcB}$-E1_gfp11_m4, $P_{rsaA}$-gfp1-9 | Present Disclosure |
| DMP877 | NA1000 $P_{phyt}$-gfp10_m2_K1, $P_{urcB}$_E1_gfp11_m4, $P_{phyt\ short}$-gfp1-9 | Present Disclosure |
| DMP911 | NA1000 $P_{urcB}$-gfp10_m2_K1, $P_{urcB}$-E1_gfp11_m4, $P_{rsaA}$-gfp1-9 | Present Disclosure |
| DMP994 | NA1000 $P_{phyt}$-gfp10_m2_K1, $P_{1361}$-E1_gfp11_m4, $P_{rsaA}$-gfp1-9 | Present Disclosure |
| DMP863 | NA1000 ΔCCNA_03498-3499 | Present Disclosure |
| DMP993 | DMP863 $P_{phyt-short}$-gfp10_m2_K1, $P_{urcB}$-E1_gfp11_m4, $P_{rsaA}$-gfp1-9 | Present Disclosure |
| DMP1009 | DMP863 $P_{phyt-short}$-CCNA_03497, $P_{phyt-short}$-gfp10_m2_K1, $P_{urcB}$-E1_gfp11_m4, $P_{rsaA}$-gfp1-9 | Present Disclosure |
| DMP1011 | NA1000 ΔuzcR $P_{phyt-short}$-gfp10_m2_K1, $P_{urcB}$_E1_gfp11_m4, $P_{rsaA}$-gfp1-9 | Present Disclosure |
| DMP910 | NA1000 $P_{phyt}$-DR1 GTCA->CAGT-gfp10_m2_K1, $P_{urcB}$-E1_gfp11_m4, $P_{rsaA}$-gfp1-9 | Present Disclosure |
| Plasmids: | | |
| VMCS2::Tn5Pvan | Contains the transposon Tn5Pvan | [152] |
| pNPTS138 | Non-replicating vector for integration and allelic replacement; oriT, kan (Km$^R$), sacB | M. R. K. Alley, unpublished |
| pDMP450 | Cat gene from pR9TT and pBBR ori and rep from pPROBE'-gfp[LVA], $P_{mrC}$-gfp mut$_3$ | Unpublished |
| pDMP460 | $P_{phyt}$-gfp mut$_3$ | Present Disclosure |
| pDMP463 | $P_{1361}$-gfp mut$_3$ | Present Disclosure |
| pDMP745 | $P_{phyt}$ -DR2 GTCA->CAGT- gfpmut$_3$ | Present Disclosure |
| pDMP746 | $P_{phy-short}$-gfpmut$_3$ | Present Disclosure |
| pDMP747 | $P_{1361}$- DR2 GTCA->CAGT-gfpmut$_3$ | Present Disclosure |
| pDMP786 | $P_{phyt}$ -DR1 GT->CA-gfpmut$_3$ | Present Disclosure |
| pDMP787 | $P_{phyt}$ -DR2 GT->CA-gfpmut$_3$ | Present Disclosure |
| pDMP788 | $P_{1361}$-DR2 GT->CA-gfpmut$_3$ | Present Disclosure |
| pDMP789 | $P_{1361-short}$-gfpmut$_3$ | Present Disclosure |
| pDMP1118 | pET52b-urpR | Present Disclosure |
| DMP791 | Pphyt-gfp10_m2_K1, PurcB_E1_gfp11_m4, PrsaA-glp1-9 | Present Disclosure |
| pDMP82 | pNPTS138 $P_{urcA}$-lacZ | [3] |
| pDMP82 | pNPTS138 $P_{urcA}$-lacZ | [3] |
| pDMP792 | pNPTS138-$P_{phyt}$-gfp10_m2_K1, $P_{urcB}$-E1_gfp11_m4, $P_{rsaA}$-gfp1-9 | Present Disclosure |
| pDMP883 | pNPTS138-$P_{phyt-short}$-gfp10_m2_K1, $P_{urcB}$-E1_gfp11_m4, $P_{rsaA}$-gfp1-9 | Present Disclosure |
| pDMP664 | pNPTS138-$P_{phyt}$-gfp10_m2_K1, $P_{urcB}$-E1_gfp11_m4, $P_{xyl}$-gfp1-9 | Present Disclosure |
| pDMP712 | $P_{phyt}$-gfp10_m2_K1, $P_{urcB}$_E1_gfp11_m4, $P_{xyl}$-gfp1-9 | Present Disclosure |
| pDMP932 | pNPTS138-$P_{urcB}$-gfp10_m2_K1, $P_{urcB}$-E1_gfp11_m4, $P_{rsaA}$-gfp1-9 | Present Disclosure |
| pDMP952 | pNPTS138-$P_{phyt}$-gfp10_m2_K1, $P_{1362}$-E1_gfp11_m4, $P_{rsaA}$-gfp1-9 | Present Disclosure |
| pDMP808 | pNPTS138-$P_{phyt}$-gfp10_m2_K1, $P_{phyt}$-E1_gfp11_m4, $P_{phyt-short}$-gfp1-9 | Present Disclosure |
| pDMP1113 | pNPTS138-$P_{phyt}$-CCNA_03497 | Unpublished |
| pDMP1114 | pNPTS138-$P_{phyt-short}$-CCNA_03497 | Present Disclosure |

Cell growth and fluorescence characterization experiments were performed in modified M5G medium (10 mM PIPES, pH 7, 1 mM NaCl, 1 mM KCl, 0.05% NH$_4$Cl, 0.01 mM Fe/EDTA, 0.2% glucose, 0.5 mM MgSO$_4$, 0.5 mM CaCl$_2$) supplemented with 5 mM glycerol-2-phosphate as the phosphate source (M5G-G$_2$P) to facilitate uranium solubility at the start of growth assays. U stocks were prepared in nitric acid as previously described [153]. A 10,000 ppm ThCl$_4$ stock was prepared in 5% nitric acid. 50-100 mM stock solutions of Pb(NO$_3$)$_2$, NiSO$_4$, ZnCl$_2$, CuSO$_4$, CaCl$_2$, MnCl$_2$, MgSO$_4$, K$_2$CrO$_4$, Na$_2$SeO$_3$, FeCl$_3$, CoCl$_2$, FeSO$_4$, NaAsO$_2$ were prepared in Milli-Q H$_2$O and a 1 g l$^{-1}$ AlCl$_3$ ICP-MS standard in HCl was used for Al addition. All strains were grown at 30° C. with shaking at 220 RPM in Erlenmeyer flasks or at 1000 RPM in 96-well plates in a PHMP-4 Thermoshaker (Grant Instruments). Strain manipulation was performed in PYE medium, containing 0.2% (wt/vol) Bacto peptone (Difco), 0.1% yeast extract (Difco), 1 mM MgSO$_4$, and 0.5 mM CaCl$_2$ and appropriate antibiotics. *Escherichia coli* HST08 (Clontech) was used for cloning following standard procedures.

Clean Deletions and Site-Directed Mutagenesis. In frame deletions of CCNA_01362 and CCNA_01363 were obtained by a two-step sacB counterselection procedure [154] as described previously [3] using the primers depicted in Table 3.

TABLE 3

Primers and qblocks

| Primer name | Primer sequence | SEQ ID NO |
|---|---|---|
| Phyt-138_F | TAACCCTTTGCAAACCGGACGGTGACCGGCAAAC | 145 |
| Phyt-138_R | GATGAACTTGCGCATGGCGGAGCCCCTCGTTTTc | 146 |
| 138_PurcA_F | ATGCGCAAGTTCATCATGAGCC | 147 |
| 138_PurcA_R | GTTTGCAAAGGGTTAATCGACGCC | 148 |
| pNTPS138_urcR_F | gGAACGATAGCGCCGGACGGTGACCGGCAAAC | 149 |
| pNTPS138_urcR_R | CGCACAAAATCCTCATCCTGAGC | 150 |
| BamHI_Pphyt_F | GACGGATCCCGGACGGTGACCGGCAAAC | 151 |
| EcoRI_Pphyt_R | GACGAATTCCCTCGTTTTcatGTCTCGCAGCTAGC | 152 |
| BamHI_P1362 | GACGGATCCAACGATAGCGCCGCCTGC | 153 |
| EcoRI_P1362 | GACGAATTCGGAAAGATCGGGACTGGGTGATGGCGCTTAGGATTCCACAG | 154 |
| Pphyt_EMSA_R | CGTTTTcatGTCTCGCAGCTAGC | 155 |
| 1362_gene_F | CTCTTTCAGGGACCCTTGATGCGCGCGCTCGTC | 156 |
| 1362_gene_R_GC | CACCAGAGCGAGCTCTCACGCCGTCCCGCCGGC | 157 |
| pET52_F | GAGCTCGCTCTGGTGCCAC | 158 |
| pET52_R | GGGTCCCTGAAAGAGGACTTCAAG | 159 |
| urcR_UR_F | caattgaagccggctCAGAAGGTCGACGCCCTGG | 160 |
| urcR_UR_R | CGCACAAAATCCTCATCCTGAGC | 161 |
| Pphyt_urcR-loc_F | gGAACGATAGCGCCGGACGGTGACCGGCAAAC | 162 |
| Pphyt_urcR-loc_R | AATCAGAATGCGcatGGCGGAGCCCCTCG | 163 |
| Pphyt-uzcR_vect_F | atgCGCATTCTGATTATCGAGGACG | 164 |
| Pphyt-uzcR_vect_R | CGGCGCTATCGTTCcctagg | 165 |
| Pphyt_rsaFb_F | GTGAAAAAGCTTAACTCGAGGGGCTCCGCCatgC | 166 |
| Pphyt_rsaFb_R | TTAAGCTTTTTTCACGCAGTCTCGCAGCTAGCTTAGCCG | 167 |
| P1362_rsaFb_F | GTGAAAAAGCTTAACTCCGAGCTCCCTAACTAACTAAtcATCT | 168 |
| P1362_rsaFb_R | TTAAGCTTTTTTCACGCAGTGATGGCGCTTAGGATTCCACAG | 169 |
| gfp19_amp_for_pxyl_F | tggggagacgaccaTATGCGTAAGGGCGAAGAGCTG | 170 |
| gfp19_amp_for_pxyl_R | cacggctggctgcagGCCGAATTTCAGGGGTACAGCA | 171 |
| Pphyt_TR_elim_F | GATCCCGGGGATTTCTCTTCGCGCCACC | 172 |
| Pphyt_promoter_shorten_R | GAAATCCCCGGGATCCCTGTGCTCTAGA | 173 |
| XbaI_PurcB | GACTCTAGACGAAGACTGGGCGGGCAG | 174 |
| BglII_PurcB_R | GACAGATCTCGGTTTGGGTGGTCGCTTGG | 175 |
| PrsaA_frag_F | Ttgtcgacgtatgacgtttgctctatagc | 176 |
| PrsaA_frag_R | CGTTCACATCGCCATCCAGCTC | 177 |
| gfp_for_PrsaA_F | ATGGCGATGTGAACGGCCATAAG | 178 |
| gfp_for_PrsaA_R | gtcatacgtcgacaaGCCGAATTTCAGGGGTACAGCA | 179 |
| Pphyt_SD_amp_R | ATGTTTTTCCTCCTTATAAAGTAGATCTTTAGTTAGTTAGGG | 180 |
| gfp1-9_for_pphyt-short_F | AAGGAGGAAAAACATATGCGTAAGGGCGAAGAGCTG | 181 |

TABLE 3-continued

Primers and qblocks

| Primer name | Primer sequence | SEQ ID NO |
|---|---|---|
| gfp1-9_for_phyt_R | GAAATCCCCGGGATCGCCGAATTTCAGGGGTACAGCA | 72 |
| urcA_loc_DR_F | GGTCGCTACCATTACCAGTTGGTC | 182 |
| urcA_loc_UR_R | TGCTTGGGTCGTTTGAGTATATGGT | 183 |
| HRP_chrom_int_F | CAAACGACCCAAGCAGGTGTCGCCCTTCGCTGAAC | 184 |
| HRP_chrom_int_R | GTAATGGTAGCGACCCCAAGCTCAGCTAATTAAGCCTCGAG | 185 |
| PurcA_UR_F | ggctggcgccaagctTGGCCGGCCGCACGCAAGGGCAGA | 186 |
| PurcA_UR_R | TTATTTTTGACACCAGACCAACTGG | 187 |
| PurcA_DR_F | TGGTGTCAAAAATAATCGCACAGGCGACCGC | 188 |
| PurcA_DR_R | gcgaattcgtggatcCAGGCGTCGAGGTGAAGTA | 189 |
| kan_elim_F | ATTCTTCCTTTTTCAATATTATTGAAGCATTTATCAG | 190 |
| kan_elim_R | AAGCTTAATAAGATGATCTTCTTGAGATCG | 191 |
| KpnI_P1362 | GACggtaccGAACGATAGCGCCGCCTGC | 192 |
| AvrII_P1362 | GACcctaggGGAAAGATCGGGACTGGGTGATGGCGCTTAGGATTCCACAG | 193 |
| 3497_for_Pphyt_plas_F | GGAAGATCTACTTTATAAGGAGGAAAAACATATGACCCGAGACCAAGACAC | 194 |
| 3497_for_Pphyt_plas_R | GACCTCGAGTCATAGGGGGCGTCC | 195 |
| 3497_for_Pphyt_short_chrome_R | TCATAGGGGGCGTCCGTCG | 196 |
| Pphyt_short_for_chrom_3497 | GGGATTTCTCTTCGCGCCACC | 197 |
| Chrome_3497_vect_amp_F | GGACGCCCCCTatgAGCG | 198 |
| chrome_vector_amp_R | GCGAAGAGAAATCCCATCATCGCCAGCCCTAGCG | 199 |
| Tripartite GFP gblock* | CAGAGATCTACTTTATAAGGAGGAAAAACATATGGA<br>TCTGCCCGACGATCATTACCTGTCCACCCAGACCATC<br>CTGTCGAAGGATCTGAATGGCACCGACGTGGGCTCC<br>GGTGGCGGGAGTGGTGGTGGCGGGAGCAAGGTCTC<br>CGCCCTCAAGGAGAACGTTAGCGCCCTGAAAGAGA<br>AGTCTCGGCCCTGACCGAAAAGGTCTCCGCCCTTA<br>AGGAAAAGGTGAGCGCTCTCAAAGAGTAAccaggcatca<br>aataaaacgaaaggctcagtcgaaagactgggccttttcgttttatctgttgtttgtcggtg<br>aacgctctctactagagtcacactggctcaccttcgggtgggccttttctgcgtttataggt<br>accCGAAGACTGGGCGGGCAGCAGCCCACTCCCAAGC<br>GCCCACCAATTATGACTTCTTTTTCATAGACTTAATT<br>CGACGTCATGAAGCAGTCGTAACGGGTGTTCGCCAT<br>CCGACCGCTCTACATCCTCGATCAACGGATCGCCAA<br>GCGACCACCCAAACCGcctaggtaactaaagattaactttataaggagg<br>aaaaacatATGAAGGTCTCCGCCCTTGAAAATGAGGTCT<br>CGGCTCTCGAAAAGGAGGTGTCGGTCCTGGAGAAAG<br>AAGTCAGCGCGCTTGAGAAGGAGGTCCGTGCCCTGG<br>AGAAGAGTGGCGGTGGGGGGTCTGGGGGCGGTTCT<br>GGGGGCGGCTCCACCTCGGAGAAGCGTGACCACATG<br>GTGCTGCTCGAATATGTCACCGCCGCGGGATCACC<br>GATGCCTCCTAAgactcctgttgatagatccagtaatgacctcagaactccat<br>ctggatttgttcagaacgctcggttgccgccgggcgttttttattggtgagaatGAAA<br>AATGCTGTACCCCTGAAATTCGGCTAttgtcgacgtatgacgtt<br>tgctctatagccatcgctgctcccatgcgcgccactcggtcgcaggggggtgtgggattt<br>tttttgggagACAATCCTCATGCGTAAGGGCGAAGAGCTG<br>TTCACGGGCGTCGTCCCCATCCTCATCGAGCTGGAT<br>GGCGATGTGAACGGCCATAAGTTCTTCGTCCGTGGG<br>GAAGGCGAGGGGATGCCACCATCGGCAAGCTGAG<br>CCTCAAGTTCATCTGCACCACCGGCAAGCTCCCGGT<br>CCCCTGGCCGACGCTCGTCACGACCCCTCACCTACGG<br>GGTGCAGTGCTTTTCCCGTTACCCCGACCACATGAA<br>GCGGCACGACTTCTTTAAGTCGGCCATGCCCGAAGG<br>CTACGTGCAGGAGCGCACCATCTATTTTAAGGACGA<br>TGGCACGTATAAGACCCGCGCGGAGGTCAAGTTCGA<br>AGGGGATACCCTGGTCAACCGTATCGAGCTGAAGGG | 200 |

TABLE 3-continued

Primers and gblocks

| Primer name | Primer sequence | SEQ ID NO |
|---|---|---|
| | CATCGACTTTAAGGAAGATGGCAACATCCTCGGGCA | |
| | CAAGCTCGAATATAATTTTAACTCCCATAAGGTCTA | |
| | CATCACCGCCGACAAGCAAAACAACGGCATCAAGG | |
| | CGAACTTTACGATCCGTCACAATGTGGAGGACGGCA | |
| | GCGTCCAGCTCGCGGATCATTATCAACAGAATACCC | |
| | CCATCGGCGATGGTCCCGTCCTCCTCCCGTAGCTCGAGATT | |

**Synthesized (Integrated DNA Technologies, gBlock) with the following components listed in 5' to 3' orientation: promoterless gfp10-m2_k1 (bolded), rrnBT1 and T7Te transcription terminators (BBa_B0015; (lowercase)), $P_{urcB}$ (uppercase)-untraslated region and RBS (lowercase) E1-gfp11-M4 (bolded), lamda $T_0$ terminator (lowercase), the rsaA promoter ($P_{rsaA}$[4]; lowercase) controlling expression of gfp1-9 (bolded). This DNA region is visually depicted in FIG. 31.

Site-directed mutagenesis was performed by amplifying the entire plasmid with the primer sets listed in Table 3. Chromosomal integration and counter selection were performed as described above, and successful substitutions were confirmed by sequencing.

Transposon Screen for Regulators of $P_{phyt}$. A chromosomally integrated $P_{phyt}$-lacZ fusion was constructed using the two-step sacB counterselection procedure [147] to swap the $P_{urcA}$ promoter in pDMP82 [3] with $P_{phyt}$. To accomplish this, a $P_{phyt}$ fragment was amplified from the C. crescentus genome with the primer pair Phyt-138_F/Phyt-138_R (Table 3) and cloned into pDMP82 that was linearized using the primers 138_PurcA_F and 138_PurcA_F using In-Fusion cloning. The $P_{phyt}$-lacZ fusion was integrated at the chromosomal urcA locus in lacA mutant strain JOE2321, yielding strain DMP470. For the transposon screen, DMP470 was electroporated with VMCS2::Tn5Pvan [152] and plated onto PYE agar plates containing 25 μg ml$^{-1}$ kanamycin. ~12,000 colonies were scraped into a PYE master solution that was frozen and stored at −80° C. The Transposon library was diluted and spread on M5G-G$_2$P agar containing 40 μg ml$^{-1}$ Xgal and 25 μM uranyl nitrate, yielding a total of ~36,000 colonies. Colonies exhibiting a white colony phenotype were selected and nested semi-arbitrary PCR was used to map the location of each transposon as described previously. [152]

Construction of Promoter-gfp Transcriptional Fusions. Plasmid-borne $P_{phyt}$-gfp and $P_{1361}$-gfp fusions were generated by amplifying $P_{phyt}$ and $P_{1361}$ fragments from the Caulobacter genome with the primer pairs BamHI_Pphyt_F/EcoRI_Pphyt_R and BamHI_P1362/EcoRI_P1362, respectively, digested with BamHI and EcoRI and cloned into the similarly digested pDMP450, generating pDMP460 and pDMP463. The promoter-gfp fusions were shortened and/or mutated by amplifying pDMP460 and pDMP463 with the primer pairs described in Table 3 and re-ligating using infusion cloning.

Tripartite GFP AND Gate Sensor Construction. A gblock (Tripartite GFP gblock; Table 6) was synthesized (Integrated DNA Technologies, gBlock) with the following components listed in 5' to 3' orientation: promoterless gfp10-m2_k1, rrnBT1 and T7Te transcription terminators (BBa_B0015), $P_{urcB}$-E1-gfp11-M4, lamda $T_0$ terminator, and gfp1-9 under the control of the rsaA promoter ($P_{rsaA}$[4]). gfp10-m2_k1 was placed under the control of $P_{phyt}$ by digesting the Tripartite GFP gblock with BglII and XhoI and ligating into the similarly digested pDMP460 to form pDMP791. DNA sequence encompassing the entire tripartite DNA and an insulating upstream rrnbT1 transcription terminator was amplified with primers HRP_chrome_int F and HRP_chrome_int R and cloned into pDMP82 that was amplified with the primers urcA_loc_DR_F and urcA-loc_UR_R using infusion cloning to form pDMP792. A variant containing GFP10-m2_k1 under the control of a shortened version of $P_{phyt}$ (i.e., the core sensor) was constructed by amplifying pDMP792 with Pphyt_TR_elim_F and Pphyt_promoter_shorten_R and re-ligating using infusion cloning, forming pDMP883. A variant of this AND gate containing gfp1-9 under the control of the xylose inducible promoter (Pxyl [6]) was constructed by amplifying the 360 bp $P_{xyl}$ fragment using Pxyl_F and Pxyl_R and cloning into pDMP792 that were amplified with gfp1-9_amp_for_pxyl_F gfp1-9_amp_for_pxyl_R using infusion cloning to form pDMP664. All tripartite GFP AND gate variants were then integrated into the chromosomal urcA locus using a two-step sacB counterselection procedure, [155] forming DMP804, DMP895, and DMP683

A control tripartite variant containing both GFP10-m2_k1 and E1-GFP11-M4 under the control of $P_{urcB}$ was constructed by directionally cloning a $P_{urcB}$ fragment, generated with primers XbaI_PurcB and BglII_PurcB_R and digested with XbaI and BglII, into the similarly digested pDMP712. Similarly, a tripartite variant containing both GFP10-m2_k1 and E1-GFP11-M4 under the control of UrtAP was constructed by directionally cloning a $P_{1362}$ fragment, generated with primers KpnI_P1362 and AvrII_P1362 and digested with KpnI and AvrII, into the similarly digested pDMP712. Both control AND gates were cloned into the pNPTS138 double recombination plasmid by amplifying with primers HRP_chrome_int F and R and cloning into pDMP82 that was amplified with the primers urcA_loc_DR_F and urcA-loc_UR_R using Infusion cloning. Finally, the $P_{xyl}$ promoter in both constructs was swapped for $P_{rsaA}$ by cloning $P_{rsaA}$, amplified with PrsaA_frag_F and PrsaA_frag_R, into the template vectors that were linearized with the primers gfp_for_PrsaA_F and gfp_for_PrsaA_R, forming pDMP932 and pDMP952. These tripartite GFP AND gate variants were then integrated into the chromosomal urcA locus using a two-step sacB counterselection procedure, [155] to form DMP911 and DMP994.

A U sensing AND gate strain (DMP993) with constitutive UzcY expression was generated by integrating the core sensor (pDMP 883) into the urcA locus of a strain deleted for CCNA_03498 and CCNA_03499 (DMP863). UzcY expression was restricted to conditions of U exposure by placing uzcY expression under the control of $P_{phyt\text{-}short}$ as follows. uzcY was amplified from the C. crescentus chromosome with primers 3497_for_Pphyt_plas_F and 3497_for_Pphyt_ plas_R, digested with BglII and XhoI, and cloned into the similarly digested pDMP746. The DNA containing the $P_{phyt\text{-}short}$-CCNA_03497 fusion was then amplified with 3497_for_Pphyt_short_chrome_R and Pphyt_short_for_chrom_3497 and cloned into pDMP1113 that was linearized using the primers chrome_3497_vect_amp_F and chrome_vector_amp_R to The resulting suicide vector (form pDMP1114) was used to integrate $P_{phyt\text{-}short}$-UZCY into DMP993 to form DMP1009.

Metal Induction Experiments. Unless otherwise specified, all metal induction experiments were performed with M5G-$G_2P$. Cells were grown to early-exponential phase, washed once with M5G-$G_2P$, and then resuspended in the same volume of fresh M5G-$G_2P$. Washed cells were added in 195 μl aliquots to black 96-well clear bottom plates containing 5 μl of the appropriate metal solution. Cell fluorescence and $OD_{600}$ were determined using a Biotek plate reader (Ex: 480/Em: 516) 2-3 hours post-metal exposure. The mean fluorescence and $OD_{600}$ value for each data point was subtracted by the respective values for a M5G-$G_2P$ blank and then the fluorescence was normalized to the $OD_{600}$. The relationship between the U concentration and the GFP output rate was modeled using a Hill function:

$$y = y_{min} + \frac{Y_{max} - Y_{min}}{1 + \left(\frac{x}{K}\right)^\eta}$$

where $y_{min}$ represents basal normalized fluorescence, $y_{max}$ is the maximum normalized fluorescence, x represents the U concentration, η is the Hill coefficient, and K is the concentration of U required for half maximal fluorescence expression. The best fit values were found by using the lsqcurvefit function in Matlab.

Cloning, Overexpression, and Purification of Strep-UrpR. urpR was amplified with primers 1362_gene_F and 1362_gene_R_GC and cloned into pET 52-b that was amplified with pET52b_F and pET52b_R using infusion cloning to generate plasmid pDMP1118. E. coli BL21(DE3) plys, containing pDMP1118, was grown at 37° C. until an OD600 of 0.5 was reached. Isopropyl-1-thio-b-D-galactopyranoside (IPTG) was added to 0.5 mM, and the cells were shifted to 30° C. for four hours of induction. Cells were harvested and stored at −20° C. The cells pellet was thawed and resuspended in 1.4 ml B-PER™ Complete Bacterial Protein Extraction Reagent (ThermoFisher), followed by addition of EDTA to 1 mM, and rocking for 15 min at room temperature. Insoluble cell debris was pelleted via centrifugation (20,000×g, 10 min at 4° C.). Strep-UrpR was isolated from cell lysates using a Strep-tactin column as described in the manufacturer's protocol (IBA Lifesciences). The protein concentration of UrpR (reported here as monomers) was determined using a Bradford protein assay (Biorad) with lysozyme as a standard.

Electrophoretic Mobility Shift Assays. A $P_{phyt}$ promoter fragment containing the region from 13 to 245 with respect to the translation initiation site was amplified from pDMP460 and pDMP475 with primers BamHI_Pphyt_F and Pphyt_EMSA_R, the latter of which was labeled with fluorescein on the 5' end. Prior to the EMSA, the Strep Tag was removed from UzrpR using HRV 3C protease (Thermo Fisher) according to the manufacturer's protocol. UrpR was phosphorylated by incubation in phosphorylation buffer (50 mM Tris, pH 7.9, 150 mM NaCl, 10 mM $MgCl_2$) with 50 mM disodium carbamyl phosphate (Sigma-Aldrich) for 1 h at 30° C. (Lynch and Lin, 1996) and immediately used in the binding assays. EMSAs were performed by incubating phosphorylated UrpR with $P_{phyt}$ DNA (50 nM) for 10 min at 37° C. in buffer containing 50 mM Tris-HCl (pH 7.9), 200 mM NaCl, 10 mM $MgCl_2$, 0.1 mg ml$^{-1}$ BSA, 5% glycerol, 1 mM DTT, and 50 μg ml$^{-1}$ poly-dI-dC. A 5% TBE mini-protean polyacrylamide gel was pre-run with 0.5×TBE at 120 V for 30 min in a Mini-PROTEAN tetra cell (Bio-Rad) prior to loading samples. Samples were run at 100V for 45 min, and the reaction products were visualized using a Biorad Gel Doc XR1 System.

Site 300 Sample Collection. Standard operating procedures for sampling and sample handling at LLNL Site 300 have been described in detail [156] and are consistent with the guidance and requirements of the U.S. EPA. The groundwater samples used in this study were collected from each well with either an electrical submersible pump or a bailer. Well samples were placed on ice, filtered using a 0.2 □m filter, and stored at 4° C.

Inductively Coupled—Plasma Mass Spectrometry/Optical Emission Spectrometry. Site 300 samples were diluted in 2% (v/v) nitric acid (trace metal grade) and spiked with an internal holmium standard. U was quantified using a Thermo XSeriesII ICP-MS run in standard mode. The sample introduction system was an ESI PFA-ST nebulizer pumped at 120 μl/min. Zn, Pb, Cu, Cd, and Cr were quantified using a Thermo iCAP 7400 radial ICP-OES in standard operating mode. Standard curves were generated using a 100 mM uranyl nitrate stock solution and 10 ppm Zn, Pb, Cu, Cd, and Cr ICP-MS standards (Inorganic Ventures).

$P_{phyt}$-lacZ and $P_{1361}$-lacZ Reporter Constructs. Chromosomally integrated $P_{phyt}$-lacZ and $P_{1361}$-lacZ translational fusions were constructed using a two-step sacB counterselection procedure [147] to swap the $P_{urcA}$ promoter in pDMP82 [3] with either $P_{phyt}$ or $P_{1361}$. pDMP82 contains the necessary sequence to generate a translational $P_{urcA}$-lacZ fusion at the $P_{urcA}$ locus in which the sequence 24 nt downstream of the urcA start codon is fused to E. coli lacZ. To accomplish this, the $P_{phyt}$ and $P_{1361}$ fragments were amplified from the Caulobacter genome with the primer pairs Phyt-138_F/Phyt-138_R and 1362_138_F/1362_138_R (Table 4), respectively and cloned into pDMP82 that was linearized using the primers 138_$P_{urcA}$_F and 138_$P_{urcA}$_F (Table 4) using In-Fusion cloning.

TABLE 4

DNA primers:

| Primer name | Primer sequence | SEQ ID NO: |
|---|---|---|
| Phyt-138_F | TAACCCTTTGCAAACCGGACGGTGACCGGCAAAC | 37 |
| Phyt-138_R | GATGAACTTGCGCATGGCGGAGCCCCTCGTTTTc | 38 |
| 1362_138_F | TAACCCTTTGCAAACGAACGATAGCGCCGCCTGC | 39 |

TABLE 4-continued

DNA primers:

| Primer name | Primer sequence | SEQ ID NO: |
|---|---|---|
| 1362_138_R | TCCCTCTGGCTGGGCGGAAAGATCGGGACTGGGTGATGG CGCTTAGGATTCCACAG | 40 |
| 138_PurcA_F | ATGCGCAAGTTCATCATGAGCC | 41 |
| 138_PurcA_R | GTTTGCAAAGGGTTAATCGACGCC | 42 |
| pNTPS138_urcR_F | gGAACGATAGCGCCGGACGGTGACCGGCAAAC | 43 |
| pNTPS138_urcR_R | CGCACAAAATCCTCATCCTGAGC | 44 |
| urcR_UR_F | caattgaagccggctCAGAAGGTCGACGCCCTGG | 45 |
| urcR_UR_R | CGCACAAAATCCTCATCCTGAGC | 46 |
| Pphyt_urcR-loc_F | gGAACGATAGCGCCGGACGGTGACCGGCAAAC | 47 |
| Pphyt_urcR-loc_R | AATCAGAATGCGcatGGCGGAGCCCCTCG | 48 |
| Pphyt-uzcR_vect_F | atgCGCATTCTGATTATCGAGGACG | 49 |
| Pphyt-uzcR_vect_R | CGGCGCTATCGTTCcctagg | 50 |
| Pphyt_rsaFb_F | GTGAAAAAGCTTAACTCGAGGGGCTCCGCCatgC | 51 |
| Pphyt_rsaFb_R | TTAAGCTTTTTTCACGCAGTCTCGCAGCTAGCTTAGCCG | 52 |
| P1362_rsaFb_F | GTGAAAAAGCTTAACTCGAGCTCCCTAACTAACTAAtcATCT | 53 |
| P1362_rsaFb_R | TTAAGCTTTTTTCACGCAGTGATGGCGCTTAGGATTCCACAG | 54 |
| gfp19_amp_for_pxyl_F | tggggagacgaccaTATGCGTAAGGGCGAAGAGCTG | 55 |
| gfp19_amp_for_pxyl_R | cacggctggctgcagGCCGAATTTCAGGGGTACAGCA | 56 |
| Pphyt_TR_elim_F | GATCCCGGGGATTTCTCTTCGCGCCACC | 57 |
| Pphyt_promoter_shorten_R | GAAATCCCCGGGATCCCTGTGCTCTAGA | 58 |
| XbaI_PurcB | GACTCTAGACGAAGACTGGGCGGGCAG | 59 |
| BglII_PurcB_R | GACAGATCTCGGTTTGGGTGGTCGCTTGG | 60 |
| PrsaA_frag_F | TtgtcgacgtatgacgtttgctctatagC | 61 |
| PrsaA_frag_R | CGTTCACATCGCCATCCAGCTC | 62 |
| gfp_for_PrsaA_F | ATGGCGATGTGAACGGCCATAAG | 63 |
| gfp_for_PrsaA_R | gtcatacgtcgacaaGCCGAATTTCAGGGGTACAGCA | 64 |
| Pphyt_SD_amp_R | ATGTTTTTCCTCCTTATAAAGTAGATCTTTAGTTAGTTA GGG | 65 |
| gfp1-9_for_pphyt-short_F | AAGGAGGAAAAACATATGCGTAAGGGCGAAGAGCTG | 66 |
| gfp1_9_for_phyt_R | GAAATCCCCGGGATCGCCGAATTTCAGGGGTACAGCA | 67 |
| urcA_loc_DR_F | GGTCGCTACCATTACCAGTTGGTC | 68 |
| urcA_loc_UR_R | TGCTTGGGTCGTTTGAGTATATGGT | 69 |
| HRP_chrom_int_F | CAAACGACCCAAGCAGGTGTCGCCCTTCGCTGAAC | 70 |
| HRP_chrom_int_R | GTAATGGTAGCGACCCCAAGCTCAGCTAATTAAGCCTCG AG | 71 |

TABLE 4-continued

DNA primers:

| Primer name | Primer sequence | SEQ ID NO: |
|---|---|---|
| PurcA_UR_F | ggctggcgccaagctTGGCCGGCCGCACGCAAGGGCAGA | 73 |
| PurcA_UR_R | TTATTTTTGACACCAGACCAACTGG | 74 |
| PurcA_DR_F | TGGTGTCAAAAATAATCGCACAGGCGACCGC | 75 |
| PurcA_DR_R | gcgaattcgtggatcCAGGCGTCGAGGTGAAGTA | 76 |
| kan_elim_F | ATTCTTCCTTTTTCAATATTATTGAAGCATTTATCAG | 131 |
| kan_elim_R | AAGCTTAATAAGATGATCTTCTTGAGATCG | 132 |
| Cat_R | CATCTTATTAAGCTTTTACGCCCCGCCCTGCCAC | 133 |
| Cat_F | TGAAAAAGGAAGAATATGGAGAAAAAAATCACTGGATATACCACCGTTG | 134 |
| pBBR1-rep_F | GACGCTAGCctgcgcaacccaagtgctacc | 135 |
| pBBR1-rep_R | CAGAAGCTTggatatgtggacgatggccgc | 136 |
| P1968_BamHI_F | GACGGATCCGAGTCAGTTGAGCCAGGCGTG | 137 |
| P1968_EcoRI_R | GACGAATTCCGTIVAGTCCATACGCGACIGIG | 138 |
| P1968_HS1_mut_F | ATAGCGCAATTTAAGTGGTCTCTGGCC | 139 |
| P1968_HS1_mut_R | CTTAAATTGCGCTATTGACGGGGATTTAACGGCAGC | 140 |
| P1968_HS2_mut_F | AATGTGGTCTCTGGCCCTCCG | 141 |
| P1968_HS1_mut_R | GCCAGAGACCACATTAATTGCGGTAATGACGGGGAT | 142 |

Both fragments were cloned into the HindIII and BamHI-digested pNPTS138 (Table 5) using In-Fusion cloning and integrated into the chromosome of a *Caulobacter crescentus* lacA mutant strain JOE2321 (Table 5) or NA1000 strain (Table 5) using the double-crossover allele replacement as described above, yielding strains DMP89 and DMP90, respectively (Table 5), integrated at the $P_{urcA}$ locus.

TABLE 5

*Caulobacter crescentus* strains and plasmids:

| Strain or plasmid | Description | Source or reference |
|---|---|---|
| Strains: | | |
| JOE2321 | *C. crescentus* CB15N ΔCC_1634 | [157] |
| DMP89 | JOE2321 $P_{urcA}$-lacZ | Unpublished |
| DMP90 | NA1000 $P_{urcA}$-lacZ | Unpublished |
| DMP470 | JOE2321 $P_{phyt}$-lacZ | Unpublished |
| DMP471 | JOE2321 $P_{1361}$-lacZ | Unpublished |
| | NA1000 ΔuzcR | [151] |
| DMP701 | NA1000 ΔparDE3 $P_{1968}$-gfp mut3 | [158] |
| DMP702 | NA1000 ΔparDE3 Pphyt-uzcRS $P_{1968}$-gfp mut3 | Unpublished |
| DMP703 | NA1000 ΔparDE3 $Pphyt_{m\_5}$-uzcRS $P_{1968}$-gfp mut3 | Unpublished |
| DMP674 | pNPTS138 ΔparDE3 P2844 elim | Unpublished |
| DMP690 | ΔparDE3 P1362-uzcRS | Unpublished |
| DMP679 | ΔparDE3 P1362-rsafB-BS-uzcRS | Unpublished |
| DMP643 | Pphyt-rsafB-BS-uzcRS | Unpublished |
| DMP601 | ΔparDE3 Pphyt-uzcRS | Unpublished |
| DMP681 | NA1000 Pphyt-hrpS, PurcB-hrpR, PhrpL-gfpmut3 | Unpublished |
| DMP683 | NA1000 $P_{phyt}$-gfp10_m2_K1, $P_{urcB}$_E1_gfp11_m4, $P_{rsaA}$-gfp1-9 | Unpublished |
| DMP804 | NA1000 $P_{phyt}$-gfp10_m2_K1, $P_{urcB}$_E1_gfp11_m4, $P_{xyl}$-gfp1-9 | Unpublished |
| DMP877 | NA1000 $P_{phyt}$-gfp10_m2_K1, $P_{urcB}$_E1_gfp11_m4, $P_{phyt\ short}$-gfp1-9 | Unpublished |
| DMP878 | NA1000 $P_{1361}$-gfp10_m2_K1, $P_{urcB}$_E1_gfp11_m4, $P_{phyt\ short}$-gfp1-9 | Unpublished |
| DMP895 | NA1000 $P_{phyt-short}$-gfp10_m2_K1, $P_{urcB}$_E1_gfp11_m4, $P_{rsaA}$-gfp1-9 | Unpublished |
| DMP213 | NA1000 ΔuzcS | [3] |
| DMP561 | NA1000 pDMP558 | [3] |
| DMP562 | NA1000 ΔuzcR pDMP558 | [3] |
| DMP563 | NA1000 pDMP559 | [3] |

TABLE 5-continued

*Caulobacter crescentus* strains and plasmids:

| Strain or plasmid | Description | Source or reference |
|---|---|---|
| DMP564 | NA1000 pDMP560 | [3] |
| DMP911 | NA1000 $P_{urcB}$-gfp10_m2_K1, $P_{urcB}$_E1_gfp11_m4, $P_{rsaA}$-gfp1-9 | Unpublished |
| DMP912 | NA1000 ΔCCNA_01362 | Unpublished |
| DMP913 | NA1000 ΔCCNA_01363 | Unpublished |
| Plasmids: | | |
| pNPTS138 | Non-replicating vector for integration and allelic replacement; oriT, kan (Km$^R$), sacB | M. R. K. Alley, unpublished |
| pDMP450 | Cat gene from pR9TT and pBBR ori and rep from pPROBE'-gfp[LVA], $P_{mrC}$-gfp mut$_3$ | Unpublished |
| pDMP460 | $P_{phyt}$-gfp mut$_3$ | Unpublished |
| pDMP463 | $P_{1361}$-gfp mut$_3$ | Unpublished |
| pDMP462 | Synthetic promoter probe vector containing gfpmut3 | Unpublished |
| pDMP460 | Cat gene from pR9TT and pBBR ori and rep from pPROBE'-gfp[LVA] | [3] |
| pDMP558 | $P_{1968}$-gfpmut3 | [3] |
| pDMP559 | $P_{1968}$(5'-CAATAG-3')-gfpmut3 | [3] |
| PDMP560 | $P_{1968}$(5'-TAAT-3')-gfpmut3 | [3] |
| pDMP499 | pNPTS138 derived vector for D51A substitution in UzcR | [3] |
| pDMP614 | pNPTS138 derived vector for $P_{phyt}$-lacZ integration into urcA locus | Unpublished |
| pDMP609 | pNPTS138 derived vector for $P_{1361}$-lacZ integration into urcA locus | Unpublished |
| pDMP610 | $P_{hrpL}$- gfp mut$_3$ | Unpublished |
| pDMP621 | pNPTS138-Pphyt$_{m\_5}$-uzcRS | Unpublished |
| pDMP673 | pNPTS138-P1361$_{m\_5}$-uzcRS | Unpublished |
| pDMP460 | $P_{phyt}$-gfpmut$_3$ | Unpublished |
| pDMP463 | $P_{1362}$- gfpmut$_3$ | Unpublished |
| pDMP791 | Pphyt-gfp10_m2_K1, PurcB_E1_gfp11_m4, PrsaA-gfp1-9 | Unpublished |
| pDMP881 | P1362-gfp10_m2_K1, PurcB_E1_gfp11_m4, PrsaA-gfp1-9 | Unpublished |
| pDMP82 | pNPTS138 $P_{urcA}$-lacZ | [3] |
| pDMP792 | pNPTS138-Pphyt-gfp10_m2_K1, PurcB_E1_gfp11_m4, PrsaA-gfp1-9 | Unpublished |
| pDMP883 | pNPTS138-Pphyt-short-gfp10_m2_K1, PurcB_E1_gfp11_m4, PrsaA-gfp1-9 | Unpublished |
| pDMP932 | pNPTS138-PurcB-gfp10_m2_K1, PurcB_E1_gfp11_m4, PrsaA-gfp1-9 | Unpublished |
| pDMP692 | pNPTS138-P1362-gfp10_m2_K1, PurcB_E1_gfp11_m4, PrsaA-gfp1-9 | Unpublished |
| pDMP664 | pNPTS138-$P_{phyt}$-tripartite-GFP | Unpublished |
| pDMP665 | pNPTS138-$P_{1362}$-tripartite-GFP | Unpublished |
| pDMP712 | $P_{phyt}$-gfp10_m2_K1, $P_{urcB}$_E1_gfp11_m4, Pxyl-gfp1-9 | Unpublished |
| pDMP713 | P1361-gfp10_m2_K1, $P_{urcB}$_E1_gfp11_m4, Pxyl-gfp1-9 | Unpublished |
| pDMP808 | pNPTS138-$P_{phyt}$-gfp10_m2_K1, Pphyt_E1_gfp11_m4, Pphyt-short-gfp1-9 | Unpublished |
| pDMP809 | pNPTS138-P1362-gfp10_m2_K1, Pphyt_E1_gfp11_m4, Pphyt-short-gfp1-9 | Unpublished |
| pDMP745 | $P_{phyt}$-DR1 GTCA->CAGT- gfpmut$_3$ | Unpublished |
| pDMP746 | $P_{phyt}$-large-TR-elim-gfpmut$_3$ | Unpublished |
| pDMP747 | P1361- DR1 GTCA->CAGT-gfpmut$_3$ | Unpublished |
| pDMP786 | $P_{phyt}$ -DR1 GT->CA-gfpmut$_3$ | Unpublished |
| pDMP787 | $P_{phyt}$ -DR2 GT->CA-gfpmut$_3$ | Unpublished |
| pDMP788 | $P_{1361}$-DR2 GT->CA-gfpmut$_3$ | Unpublished |
| pDMP789 | $P_{1361}$ shorten- gfpmut$_3$ | Unpublished |
| pDMP748 | pNPTS138-PurcB-gfp10_m2_K1, PurcB_E1_gfp11_m4, Pxyl-gfp1-9 | Unpublished |
| pDMP741 | PurcB-gfp10_m2_K1, PurcB_E1_gfp11_m4, Pxyl-gfp1-9 | Unpublished |
| pDMP558 | $P_{1968}$-gfpmut$_3$ | [3] |

$P_{phyt}$-gfp and $P_{1361}$-gfp Constructs. Plasmid-borne $P_{phyt}$-gfp and $P_{1361}$-gfp fusions were generated by amplifying $P_{phyt}$ and $P_{1361}$ fragments from the *Caulobacter* genome with the primer pairs Phyt-138_F/Phyt-138_R and 1362_138_F/1362_138_R (Table 4), respectively, digested with BamHI and EcoRI and cloned into the similarly digested pDMP450 (Table 5), generating pDMP460 and pDMP463 (Table 5).

Construction of a CCNA_01968 Promoter-Gfp Transcriptional Fusion. A synthetic vector with a P15A origin, kanamycin resistance cassette and gfpmut3 gene insulated with an upstream rrnB terminator 1 (DNA2.0) was used as a template to construct promoter-gfp fusions. First, the cat gene (chloramphenicol acetyltransferase) from pNJH123 was amplified with the primers cat_F and cat_R and cloned into pDMP462 that was linearized with the primers kan_e-lim_F and kan_elim_R using infusion cloning. The p15A origin was then swapped with a pBRR-rep1 origin that was amplified from pPROBE-GFP' using the primers pBBR1-rep_F and pBBR1-rep_R and the restriction enzymes NheI and HindIII, generating pDMP460. The DNA sequence region from 170 to −9 with respect to the translation initiation site of CCNA_01968 was amplified with P1968_BamHI_F and P1968_EcoRI_R, digested with EcoRI and BamHI, and cloned into the similarly digested pDMP460 to construct a CCNA_01968-promoter gfp fusion (pDMP558). Site directed mutagenesis was performed with the primers P1968_HS1_mut_F and P1968_HS1_mut_R to mutate UzcR half site one from 5'-CATTAC-3' to 5'-CAATAG-3' and primers P1968_HS2_mut_F and P1968_HS2_mut_R and to mutate the half site two from 5'-TTAA-3' to 5'-TAAT-3', generating pDMP559 and pDMP560, respectively.

Engineering of constructs to place the uzcRS operon under the transcriptional control of $P_{phyt}/P_{1361}$. The two mapped promoters of uzcR were replaced with $P_{1361}$ and $P_{phyt}$ as follows. First, a synthetic DNA containing the rrnb T1 and T7Te transcription terminators (BBA_0B0015) followed by a $P_{1361}$ fusion with the first 168 nucleotides of uzcR was prepared (Integrated DNA Technologies, Inc.) Then, pDMP499 (Table 5), a pNPTS138-based vector containing the DNA sequence for substituting the aspartate residue at position 51 for alanine was amplified with primers pNTPS138_urcR_F and pNTPS138_urcR_R (Table 4) and the 531 bp region upstream of the uzcR promoters was amplified with urcR_UR_F and urcR_UR_R (Table 4). All three DNAs were ligated together to make pDMP610 (Table 5). $P_{phyt}$ was swapped for $P_{1361}$ using infusion cloning with the fragments generating by amplifying pDMP610 (Table 5) with Pphyt-uzcR_vect_F/Pphyt-uzcR_vect_R and pDMP614 with Pphyt_urcR-loc_F/Pphyt_urcR-loc_R (Tables 4 and 5).

The resulting suicide vectors pDMP609 and pDMP614 (Table 5) were electroporated into FC922 (Table 5) and the P1361-uzcRS (DMP690) and Pphyt-uzcRS strains (DMP601) (Table 5) were obtained by a two-step sacB counterselection procedure [147]. The UzcR binding site from the rsaFb promoter TGCGTGAAAAAAGCTTAACT (SEQ ID NO: 201) was inserted downstream of the transcriptional start site of $P_{phyt}$ and $P_{1361}$ as follows. Plasmids pDMP609 and pDMP614 and were amplified with the primer pairs P1362_rsaFb_F/P1362_rsaFb_F and Pphyt_rsaFb_F/Pphyt_rsaFb_F, respectively (Table 5) and re-ligated using InFusion cloning. The resulting suicide vectors pDMP673 and pDMP621 (Table 5) were electroporated into *Caulobacter* strain FC922 and the P1361m_5-uzcRS (DMP679) and Pphytm_5-uzcRS (DMP643) strains (Table 5) were obtained by the two-step sacB counterselection procedure. All strains were transformed with pDMP558, encoding a CCNA_01968 promoter gfpmut3 fusion (Table 5).

Engineering of Constructs to Place Expression of hrpS Under Control of $P_{Phyt}$ or $P_{1361}$, and hrpR Under Control of $P_{urcB}$. $P_{hrpL}$ DNA (SEQ ID 80) was synthesized (IDT), then digested with BamHI and BglII and ligated into the similarly digested pDMP450, generating pDMP610. Next, the synthetic Pphyt-hrpS_PurcB-hrpR DNA fragment was digested with XbaI and BamHI and cloned into the similarly digested pDMP610 to generate pDMP612. pDMP612 was cloned into NA1000 to produce DMP681.

TABLE 6

DNA sequences of genetic molecular components:

| Genetic molecular component | DNA sequence | SEQ ID NO: |
|---|---|---|
| $P_{1361}$ promoter | GAACGATAGCGCCGCCTGCGAGCGCGACCTCAGGCCTCGGACGAAGCGCGT CCGGGGCCTTTTCTTGTCGATGTTCAGCGCCTGGTTACCGGCGATGGCGCG GTGTCAGCGTTCGGGCGTTGCGATGCGTCAGGAGCGTGTCAGGATGCCTGT GGAATCCTAAGCGCCATCACCCAGTCCCGATCTTTCC | 77 |
| $P_{phyt}$ promoter | CCGGACGGTGACCGGCAAACCACCGCTGTCATGAATGCGTTTTGAAGCTTC GCCATAACGCGCCTTGGGTATCCGGTTCGGAACGCGGCGCTTTCGTTGACC TCTGGCCACGGAGAATTCTCCATCCCAAAGAGGGTGTGGCCCAAAGAGGGT GTGGATTTCTCTTCGCGCCACCCGTTTCGTCAGCCGGACGTCAGGTCCAGA CGGCTAAGCTAGCTGCGAGACAtgAAAACGAGGGGCTCCGCC | 78 |
| rrnBT1-T7T3-P1361-uzcr (1-168 nt) | TGAGGATTTTGTGCGccaggcatcaaataaaacgaaaggctcagtcgaaag actgggcctttcgttttatctgttgtttgtcggtgaacgctctctactaga gtcacactggctcaccttcgggtgggcctttctgcgtttataccctaggGAA CGATAGCGCCGCCTGCGAGCGCGACCTCAGGCCTCGGACGAAGCGCGTCCG GGGCCTTTTCTTGTCGATGTTCAGCGCCTGGTTACCGGCGATGGCGCGGTG TCAGCGTTCGGGCGTTGCGATGCGTCAGGAGCGTGTCAGGATGCCTGTGGA ATCCTAAGCGCCATCACCCAGTCCCGATCTTTCCGAGCTCCTAACTAACT AAtcATCTACTTTATAAGGAGGAAAAACATatgCGCATTCTGATTATCGAG GACGACCTGGAAGCCGCCGGCGCCATGGCGCACGGGCTCAAGGAAGCCGGC TACGACGTCGCCCACGCGCCGGACGGCGAGGCGGGCCTGGCCGAGGCCCAG AAGGGCGGCTGGGACGTGCTGGTCGTCGCCCGGATGATGCCCAAG | 79 |
| PhrpL | GACGGATCCGCCGGATTATGTCCGCTGAGTGGGTCACGGTCCCGGATCAGT TCCCTTGCGAAGCTGACCGATGTTTTTGTGCCAAAAGCTGTTGTGGCAAAA AACGGTTTGCGCAAAGTTTTGTATTACAAAGAATTTCACATTTTAAAATAT CTTTATAAATCAATCAGTTATTTCTATTTTTAAGCTGGCATGGTTATCGCT ATAGGGCTTGTACAGATCTGTC | 80 |
| Tripartite GFP gblock | CAGAGATCTACTTTATAAGGAGGAAAAACATATGGATCTGCCCGACGATCA TTACCTGTCCACCCAGACCATCCTGTCGAAGGATCTGAATGGCACCGACGT GGGCTCCGGTGGCGGGAGTGGTGGTGGCGGGAGCAAGGTCTCCGCCCTCAA GGAGAACGTTAGCGCCCTGAAAGAGAAAGTCTCGGCCCTGACCGAAAAGGT CTCCGCCCTTAAGGAAAAGGTGAGCGCTCTCAAAGAGTAAccaggcatcaa ataaaacgaaaggctcagtcgaaagactgggcctttcgttttatctgttgt ttgtcggtgaacgctctctactagagtcacactggctcaccttcgggtggg cctttctgcgtttataggtaccCGAAGACTGGGCGGGCAGCAGCCCACTCC CAAGCGCCCACCAATTATGACTTCTTTTTCATAGACTTAATTCGACGTCAT GAAGCAGTCGTAACGGGTGTTCGCCATCCGACCGCTCTACATCCTCGATCA ACGGATCGCCAAGCGACCACCCAAACCGcctaggtaactaaagattaactt tataaggaggaaaaacatATGAAGGTCTCCGCCCTTGAAAATGAGGTCTCG GCTCTCGAAAAGGAGGTGTCGGTCCTGGAGAAAGAAGTCAGCGCGCTTGAG AAGGAGGTCCGTGCCCTGGAGAAGAGTGGCGGTGGGGGGTCTGGGGGCGGT TCTGGGGGCGGCTCCACCTCGGAGAAGCGTGACCACATGGTGCTGCTCGAA TATGTCACCGCCGCCGGGATCACCGATGCCTCCTAAgactcctgttgatag atccagtaatgacctcagaactccatctggatttgttcagaacgctcggtt gccgcgggcgttattattggtgagaatGAAAAATGCTGTACCCCTGAAAT TCGGCTAttgtcgacgtatgacgtttgctctatagccatcgctgctcccat gcgcgccactcggtcgcaggggtgtgggattttttttgggagACAATCCT CATGCGTAAGGGCGAAGAGCTGTTCACGGGCGTCGTCCCCATCCTCATCGA GCTGGATGGCGATGTGAACGGCCATAAGTTCTTCGTCCGTGGGGAAGGCGA | 81 |

TABLE 6-continued

DNA sequences of genetic molecular components:

| Genetic molecular component | DNA sequence | SEQ ID NO: |
|---|---|---|
| | GGGGGATGCCACCATCGGCAAGCTGAGCCTCAAGTTCATCTGCACCACCGG<br>CAAGCTCCCGGTCCCCTGGCCGACGCTCGTCACGACCCTCACCTACGGGGT<br>GCAGTGCTTTTCCCGTTACCCCGACCACATGAAGCGGCACGACTTCTTTAA<br>GTCGGCCATGCCCGAAGGCTACGTGCAGGAGCGCACCATCTATTTTAAGGA<br>CGATGGCACGTATAAGACCCGCGCGGAGGTCAAGTTCGAAGGGGATACCCT<br>GGTCAACCGTATCGAGCTGAAGGGCATCGACTTTAAGGAAGATGGCAACAT<br>CCTCGGGCACAAGCTCGAATATAATTTTAACTCCCATAAGGTCTACATCAC<br>CGCCGACAAGCAAAACAACGGCATCAAGGCGAACTTTACGATCCGTCACAA<br>TGTGGAGGACGGCAGCGTCCAGCTCGCGGATCATTATCAACAGAATACCCC<br>CATCGGCGATGGTCCCGTCCTCCTCCCGTAGCTCGAGATTTGAGGATTTTG | |
| Pphyt-<br>hrpS_PurcB-<br>hrpR | TGCGccaggcatcaaataaaacgaaaggctcagtcgaggctcaccttcggg<br>aagactgggcctttcgttttatctgttgtttgtcggtgaacgctctctact<br>agagtcacacttgggcctttctgcgtttatacctaggGAACGATAGCGCCG<br>CCTGCGAGCGCGACCTCAGGCCTCGGACGAAGCGCGTCCGGGGCCTTTTCT<br>TGTCGATGTTCAGCGCCTGGTTACCGGCGATGGCGCGGTGTCAGCGTTCGG<br>GCGTTGCGATGCGTCAGGAGCGTGTCAGGATGCCTGTGGAATCCTAAGCGC<br>CATCACCCAGTCCCGATCTTTCCGAGCTCCCTAACTAACTAAtcATCTACT<br>TTATAAGGAGGAAAAACATatgCGCATTCTGATTATCGAGGACGACCTGGA<br>AGCCGCCGGCGCCATGGCGCACGGGCTCAAGGAAGCCGGCTACGACGTCGC<br>CCACGCGCCGGACGGCGAGGCGGGCCTGGCCGAGGCCCAGAAGGGCGGCTG<br>GGACGTGCTGGTCGTCGACCGGATGATGCCCAAG | 82 |

Example 1: Identification of U-selective Promoters $P_{1361}$ and $P_{phyt}$ in *Caulobacter crescentus*

The highest U-induced gene urcA (uranium response in *Caulobacter*) has been exploited as a U sensor that can detect micromolar U concentrations in contaminated ground water [55]. However, previously the molecular mechanisms governing $P_{urcA}$ regulation were not examined, nor its cross-reactivity with environmentally relevant metal cations. To address this, the specificity was characterized and the transcriptional regulatory mechanism governing expression of the $P_{urcA}$ was identified [3]. Although most metals failed to induce $P_{urcA}$, significant induction was observed with the metal ions Zn and Cu and to a lesser degree, Cd (FIG. 2 Panel A).

The UzcRS two-component system was identified as the regulatory system responsible for U, Zn, and Cu-dependent activation of $P_{urcA}$ and 41 other promoters in the *Caulobacter* genome [3]. Together, these data suggest that the $P_{urcA}$ does not have satisfactory selectivity to function as a standalone sensor of environmental U. Nevertheless, since UzcRS exhibits a U-concentration dependence in a wide range of media conditions, a sensor that incorporates UzcRS as one component within a more advanced U-sensitive genetic circuit comprising an additional point of U sensing that is independent of the UzcRS system could produce an effective U sensor.

To identify additional U responsive genes that are not cross-reactive with other metal cations, gene expression was monitored in the presence of U and Zn using RNA-seq (FIG. 1). Two additional promoters ($P_{1361}$ (promoter of operon containing CCNA_01362) and $P_{phyt}$ (promoter of CCNA_01353)) that are strongly responsive to U but not to Zn. To further characterize the specificity of these promoters, the DNA sequences corresponding to each promoter were cloned upstream of lacZ and gfpmut3 reporter genes and reporter expression was monitored following exposure to 10 different metals. Surprisingly, the data revealed that both promoters lack cross-reactivity with metal ions commonly encountered in the environment (FIG. 2 Panels B-C).

Furthermore, U-dependent induction of these promoters was not dependent on UzcRS; $P_{1361}$-gfp expression was induced 10.5 (±0.8) for wild type and 9.6 (±0.5) for a strain deleted for uzc during exposure to 20 μM U, suggesting that that regulation of these promoters is governed by a regulatory mechanism distinct from $P_{urcA}$. In other words, U-sensing by $P_{phyt}/P_{1361}$ and $P_{urcA}$ is mediated through independent mechanisms. As such, these sensors are suitable for U sensor construction.

Figure 4:
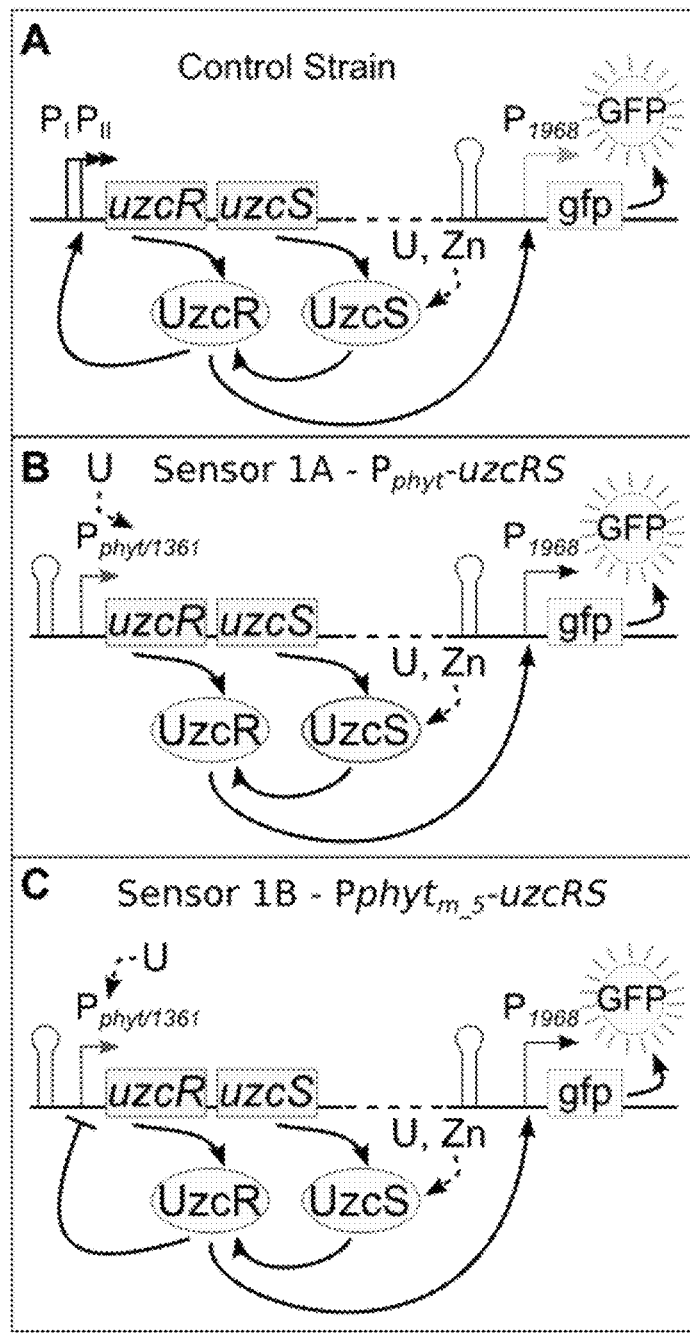
FIG. 4 Panels A-C shows schematics illustrating the stepwise genetic engineering of an exemplary U-sensitive genetic circuit with incremental improvements from Panel A to Panel C to enhance specificity for U, resulting in a genetic circuit comprising an 'in series' AND gate comprising two points of U-sensing by (1) $P_{phyt}$ or $P_{1361}$ and (2) UzcRS two component system. Panel A shows a schematic of a U-sensitive genetic circuit comprising uzcRS under the control of the native $P_{uzcR}$ promoters P1 and P2 and GFP expression under the control of UzcR-regulated promoter $P_{1968}$. In this genetic circuit, binding of U directly or through indirect stimulation of UzcS causes the UzcS-mediated phosphorylation and activation of UzcR, leading to the homodimerization of UzcR and DNA binding of the UzcR dimer at the m_5 binding sites in the $P_{1968}$ promoter. The genetic circuit shown in Panel A only requires one point of U sensing, by UzcRS. As expected, this genetic circuit produces a high fluorescence signal in response to U, Zn, and Cu, as shown in FIG. 5. Incremental improvements of this circuit are shown in Panel B and Panel C to enhance selectivity for U. Panel B shows a schematic of a U-sensitive genetic circuit where $P_I$ and $P_{II}$ are replaced with $P_{phyt}$ or $P_{1361}$ such that uzcRS expression is now dependent on activation by these U-specific promoters. This construct requires two points of U sensing for reporter activation, (1) activation of uzcRS transcription by $P_{phyt}$ or $P_{1361}$ and (2) stimulation of UzcRS transcriptional regulatory activity. This sensor shows greater signal in response to U compared to the genetic circuit shown in Panel A, as shown in FIG. 5 Panel A. Importantly, in the genetic circuit shown in FIG. 4 Panel B, Cu-sensing has been completely abolished while Zn induction with the range of inducing Zn concentrations narrowed compared to the UzcRS sensor alone; also, the ratio of the U signal output to that of Zn has been increased from 1.6 to 3.5 as shown in FIG. 5 Panel B.

Example 2: Engineering of a U-Sensitive Genetic Circuit Comprising an 'in Series' AND Gate Wherein the uzcRS Operon is Placed Under the Transcriptional Control of $P_{phyt}/P_{1361}$ In the *C. crescentus* NA1000 genome, uzcR and uzcS are physically separated by genes encoding the ParDE3 toxin anti-toxin (TA) system, together forming a putative four-gene operon [112]. Although uzcR and uzcS are conserved throughput much of alphaproteobacteria, the insertion of parDE3 between uzcR and uzcS is unique to a subset of the *Caulobacter* genus; uzcR and uzcS are adjacently located in the majority of closely related alphaproteobacteria [3] including *C. crescentus* strain OR37, an environmental isolate from a U-contaminated site [97]. The $parDE_3$ system does not contribute to the metal-dependent regulation by UzcRS [3]. Given this result and the potential toxicity associated with parDE3 overexpression, the parDE3 TA system was deleted, so that uzcR and uzcS are adjacently located. The expression of uzcR is controlled by two promoters ($P_1$ and $P_2$) in *C. crescentus* [3], which enables sufficient basal expression of uzcRS to activate transcription in response to metal (U, Zn, Cu). There is also a putative UzcR binding site located upstream of $P_1$ that likely yields a positive feedback loop. Indeed, UzcR protein levels increase in a uzcS-dependent manner in response to metal sensing. Deletion of the parDE3 TA system and the parD promoter places uzcS expression under the exclusive control of $P_1$ and $P_2$ (FIG. 4 Panel A). A "control strain" of *Caulobacter* was generated comprising a U-sensitive genetic circuit in which uzcR is under the control of $P_1$ and $P_2$ and uzcS under the control of Pi and $P_2$, (FIG. 4 Panel A). As expected, this strain produces a high fluorescence signal in response to U, Zn, Cu (FIG. 5 Panel A left, middle, right graphs, respectively). Incremental improvements were made to this circuit to enhance specificity, as described below.

Figure 5:
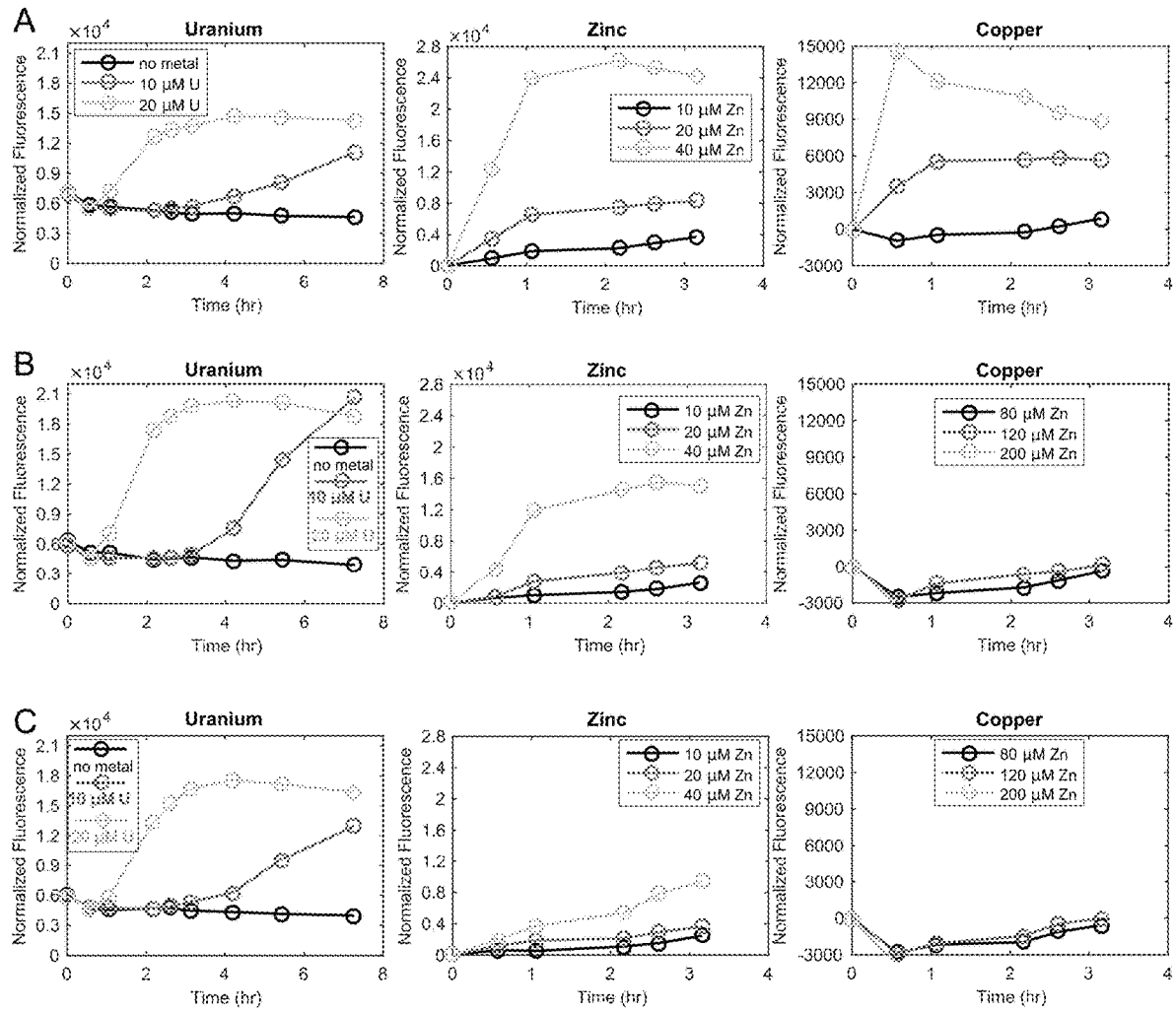
FIG. 5 shows graphs of exemplary GFP reporter fluorescence produced by the U-sensitive genetic circuits shown in FIG. 4, comprised in the host organism *C. crescentus* NA1000, upon exposure to U, Zn or Cu.

To enhance the selectivity of UzcRS for U, P1 and P2 were replaced with $P_{phyt}$ or $P_{1361}$ such that uzcRS expression is dependent on activation by these U-specific promoters (FIG. 4 Panel B). This genetic circuit requires two points of U sensing for reporter activation, (1) activation of uzcRS transcription by $P_{phyt}$ or $P_{1361}$ and (2) stimulation of UzcRS transcriptional activity. *Caulobacter* comprising this sensor showed greater reporter expression signal in response to U (FIG. 5 Panel B, left graph) compared to the control (FIG. 5 Panel A, left graph). Importantly, Cu-sensing has been completely abolished (FIG. 5 Panel B, right graph) while Zn induction with the range of inducing Zn concentrations narrowed (FIG. 5 Panel B, middle graph) compared to the $P_{urcA}$ sensor alone (FIG. 5 Panel A, middle graph). The ratio of the U signal output to that of Zn has been increased from 1.6 to 3.5 (FIG. 5 Panel B, left and right graphs).

To further improve specificity of U sensing, a negative feedback loop was incorporated into the circuit, whereby UzcR represses its own expression from $P_{phyt}$ or $P_{1361}$, in order to minimize the basal expression of the uzcRS operon. Specifically, a UzcR binding site was placed downstream of the $P_{phyt}$ or $P_{1361}$ transcription start site (FIG. 4 Panel C). Although the UzcR binding site from the rsaFb promoter was used, any m_5 site is suitable. *Caulobacter* comprising this sensor showed strong responsiveness to U (FIG. 5 Panel C, left graph) and further shifted ratio of U response to that of Zn to 5.5 (FIG. 5 Panel C, left and right graphs).

Example 3: Engineering of a U-Sensitive Genetic Circuit Comprising an 'in Parallel' HRP AND Gate This Example describes the engineering of a U-sensitive genetic circuit comprising an 'in parallel' AND gate that utilizes the HRP AND gate system from *Pseudomonas syringae* that was recently developed in *E. coli* [126]. In this system, both HrpS and HrpR are required for 054 dependent activation of the hrpL promoter ($P_{hrpL}$). Expression of HrpS or HrpR alone is not sufficient for transcriptional activation.

The genetic circuit described in this Example contains genetic components whose expression is controlled independently by (1) $P_{phyt}$ or $P_{1361}$ and (2) UzcRS systems, and reporter expression requires both HrpS and HrpR to be expressed.

To generate this U-sensing AND gate, the expression of hrpS was placed under the control of $P_{Phyt}$ or $P_{1361}$, while hrpR was placed under the control of $P_{urcB}$, a UzcRS-dependent promoter that was recently identified that has lower basal activity compared to $P_{urcA}$ [3] (FIG. 6 Panel A). A $P_{hrpL}$-gfp fusion was generated as a reporter and requires $P_{Phyt}/P_{1361}$ and $P_{urcB}$ to be active to generate a fluorescent signal.

Example 4: Engineering of a U-Sensitive Genetic Circuit Comprising an 'in Parallel' Tripartite GFP AND Gate This Example describes the engineering of a U-sensitive genetic circuit comprising an 'in parallel' AND gate that utilizes the tripartite GFP system [5], which requires expression of gfp10, gfp11 and gfp1-9 for reporter expression (FIG. 6 Panel B).

To construct an in parallel AND gate comprising the tripartite GFP system a gblock (Tripartite GFP gblock) was synthesized (Integrated DNA Technologies, gBlock) with the following components listed in 5' to 3' orientation: GFP10-m2_k1, rrnBT1 and T7Te transcription terminators, E1-GFP11-M4 under the control of the UzcRS promoter ($P_{urcB}$), lamdaT$_0$ terminator, gfp1-9 under the control of the rsaA promoter ($P_{rsaA}$ [4]). GFP10-m2_k1 was placed under the control of $P_{phyt}$ or $P_{1361}$ by digesting Tripartite GFP gblock with BglII and XhoI and ligating into the similarly digested pDMP460 and pDMP463, respectively, to form pDMP791 and pDMP881. DNA sequence encompassing the entire $P_{phyt}/P_{1361}$ tripartite DNA and an insulating upstream rrnbT1 transcription terminator was amplified with primers HRP_chrome_int F and R and cloned into pDMP82 that was amplified with the primers urcA_loc_DR_F and urcA-loc_UR_R using infusion cloning to form pDMP792 and pDMP692. A variant of this AND gate containing gfp1-9 under the control of the xylose inducible promoter (Pxyl [6]) was constructed by amplifying the 360 bp P, fragment using Pxyl_F and Pxyl_R and cloning into pDMP792 ($P_{phyt}$ version) and pDMP692 ($P_{1361}$ version) that were amplified with gfp1-9_amp_for_pxyl_F gfp1-9_amp_for_pxyl_R using infusion cloning to form pDMP664 and pDMP 665, respectively. A variant of this AND gate containing gfp1-9 under the control of the shortened $P_{phyt}$ promoter was constructed by amplifying pDMP736 with Pphyt_TR_elim_F and Pphyt_SD_amp_R and cloning this 137 bp fragment into pDMP712 ($P_{phyt}$ version) or pDMP713 ($P_{1361}$ version) that was amplified with gfp1-9_for_pphyt-short_F and gfp1-9_for_phyt_R using infusion cloning to form pDMP808 and pDMP809. A variant containing GFP10-m2_k1 under the control of a shortened version of $P_{phyt}$ and gfp1-9 under the control of $P_{rsaA}$ was constructed by amplifying pDMP792 with Pphyt_TR_elim_F and Pphyt_promoter_shorten_R and re-ligating using infusion cloning, forming pDMP883. Lastly, a control tripartite variant containing both GFP10-m2_k1 and E1-GFP11-M4 under the control of $P_{urcB}$ was constructed in three parts. First, a $P_{urcB}$ fragment generated with primers XbaI_PurcB and BglII_PurcB_R was digested with XbaI and BglII and directionally cloned into the similarly digested pDMP712, forming pDMP741. Next, DNA sequence encompassing the entire $P_{urcB}$ tripartite DNA and an insulating upstream rrnbT1 transcription terminator was amplified with primers HRP_chrome_int F and R and cloned into pDMP82 that was amplified with the primers urcA_loc_DR_F and urcA-loc_UR_R using infusion cloning to form pDMP748. Finally, the P, promoter was swapped for $P_{rsaA}$ by cloning $P_{rsaA}$, amplified with PrsaA_frag_F and PrsaA_frag_R, into pDMP748 that was amplified with gfp_for_PrsaA_F and gfp_for_PrsaA_R, forming pDMP932. These tripartite GFP AND gate variants were then integrated into the chromosomal urcA locus using a two-step sacB counterselection procedure [155].

Figure 11:
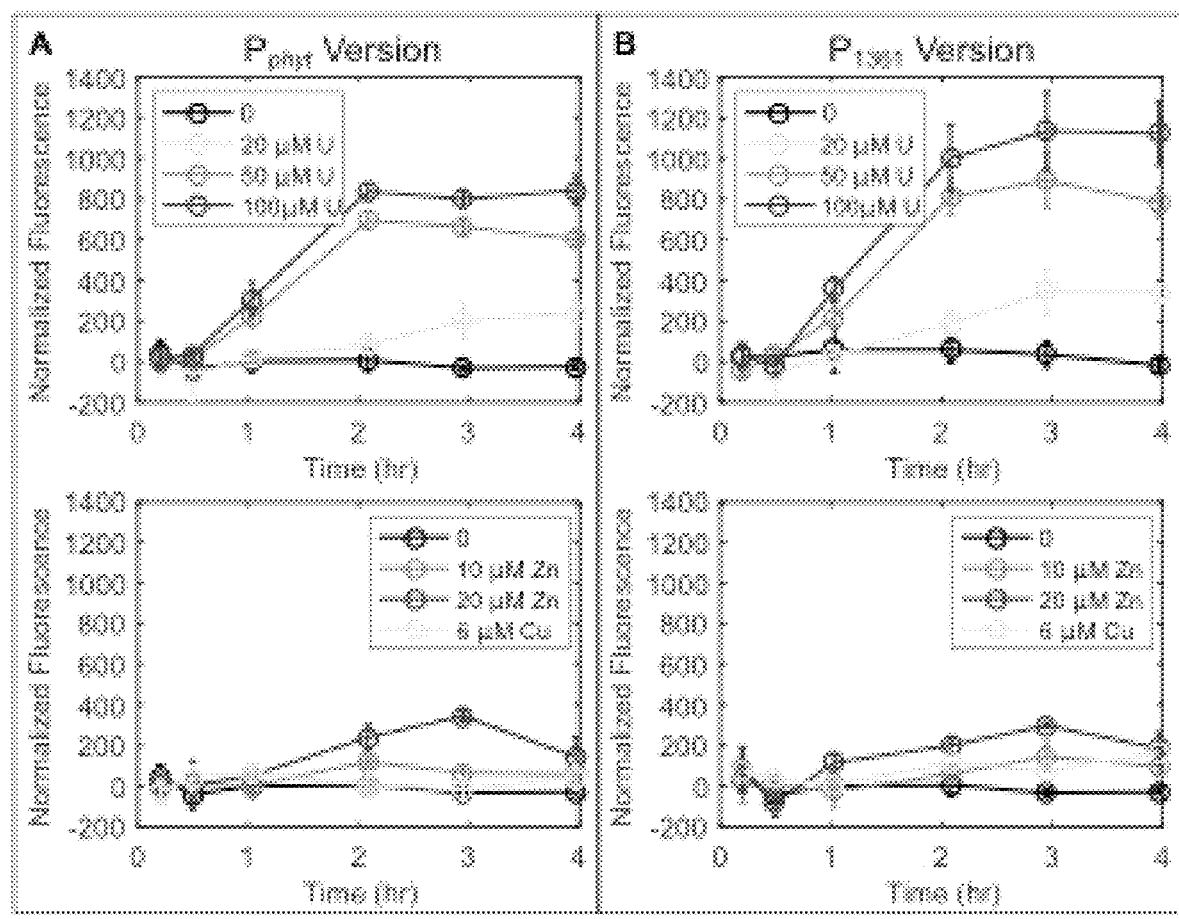
FIG. 11 shows graphs reporting exemplary data corresponding to the exemplary U-sensitive genetic circuit in FIG. 6 Panel B. Graphs reporting quantification of GFP fluorescence produced by *C. crescentus* NA1000 comprising the U-sensitive genetic circuit shown in FIG. 6 Panel B with gfp10 under the control of $P_{phyt}$ (Panel A) or $P_{1361}$ (Panel B) in response to exposure to 20, 50, and 100 µM U (FIG. 11 Panels A and B, upper graphs), or 10, 20 µM Zn and 6 µM Cu (FIG. 11 Panels A and B, lower graphs). In this version of the circuit, gfp1-9 is controlled by $P_{xyl}$ and gfp1-9 expression is induced with 10 mM xylose. Fluorescence output for both $P_{phyt}$ and $P_{1361}$ sensor variants is plotted as a function of time following metal exposure and was normalized to the fluorescence of a strain lacking the UzcR regulator. Cells were grown to mid-exponential phase in M5G-G2P media, washed once with fresh media, then resuspended in fresh media containing the indicated metal concentration.

FIG. 11 shows graphs reporting exemplary data corresponding to the exemplary U-sensitive tripartite GFP genetic circuit.

Tripartite GFP system with PrsaA-gfp1-9: Can detect U in the 2-20 uM range. When a growth media containing Glycerol-2-phosphate as the P source is used, the signal amplitude is higher but the responsive range is shifted to 8 uM-30 uM. Higher concentrations have a diminished signal output. The shifted range likely reflects U coordination by glycerol-2-phosphate that reduces the bioavailability.

Figure 22:
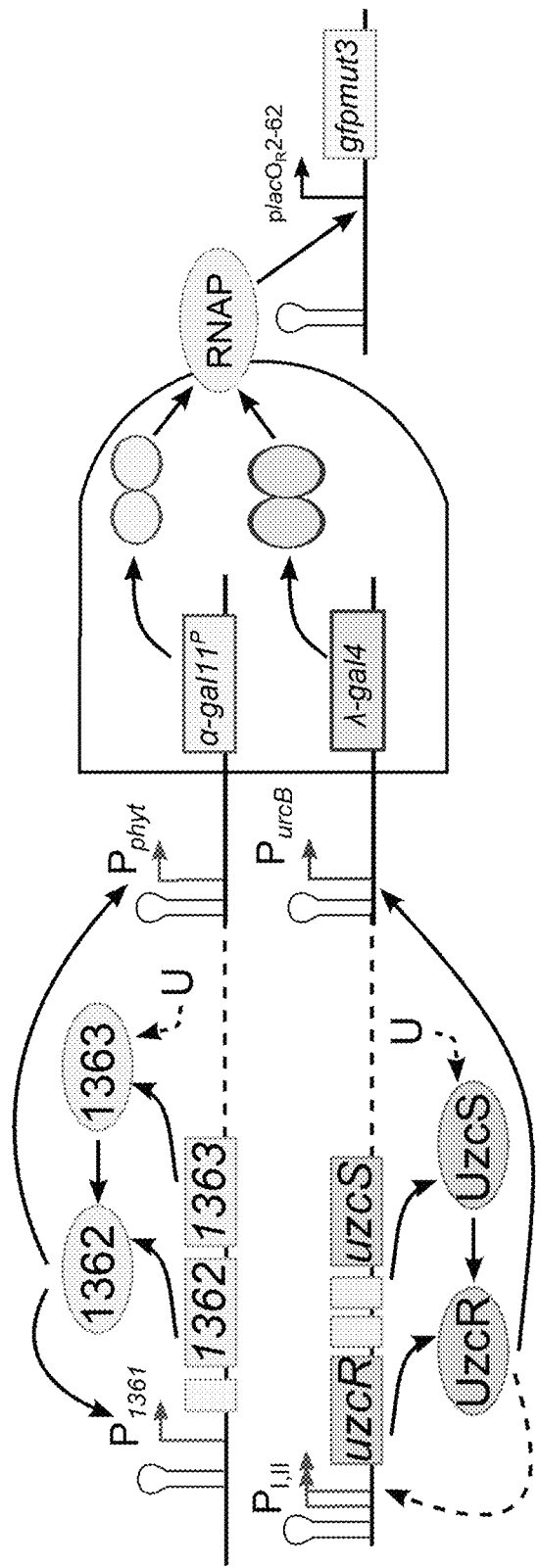
FIG. 22 shows a schematic showing an exemplary AND gate comprised in a U-sensitive genetic circuit wherein an alpha-gal11P fusion and a lambda repressor-gal4 fusion are expected to be driven by a combination of $P_{phyt}/P_{1361}$ and any UzcRS regulated promoter.
Figure 23:
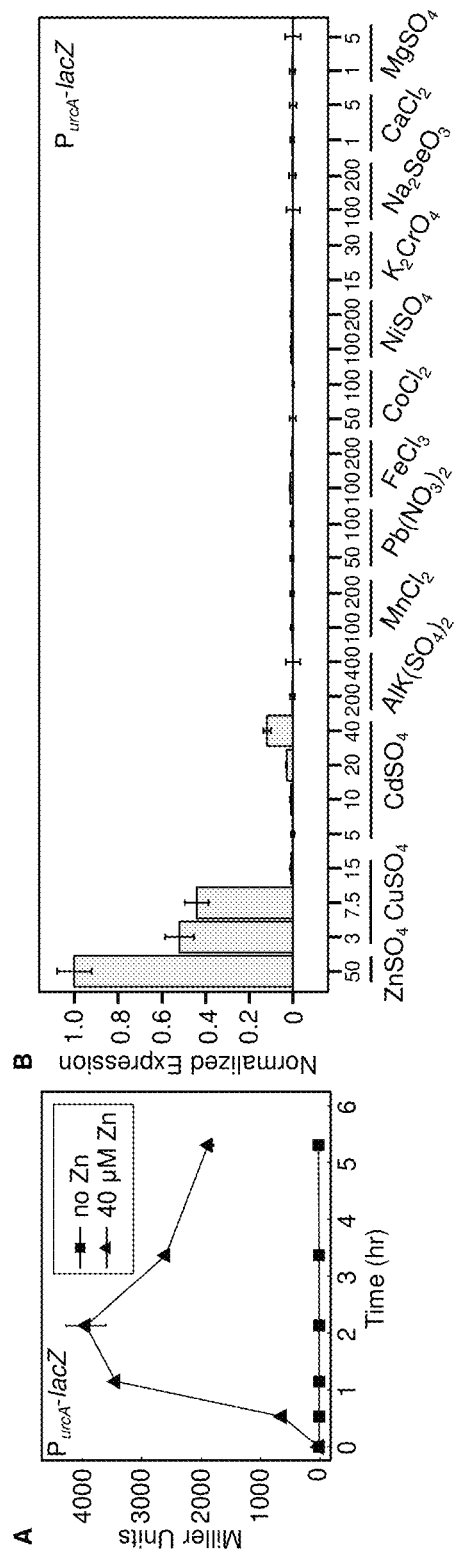
FIG. 23 shows in some embodiments the determination of metal specificity of $P_{urcA}$. Panel (A): Time course of chromosomal $P_{urca}$-lacZ induction after treatment of early exponential phase cells with or without Zn. Cells were grown in PYE and the β-galactosidase activity at each time point is depicted. Error bars represent the standard deviation of biological triplicates. Panel (B): Metal specificity of $P_{urcA}$ was determined by treating mid-exponential phase cells with various metal cations in modified M5G media supplemented with 1.3 mM inorganic phosphate for two hours before determining β-galactosidase activity. Expression values were normalized to the level of expression with 50 µM Zn and error bars represent that standard deviation calculated using a formula for propagation of standard error [20]. The depicted metal concentrations are in units of µM except for $CaCl_2$ and $MgSO_4$ that were added at mM concentrations.
Figure 24:
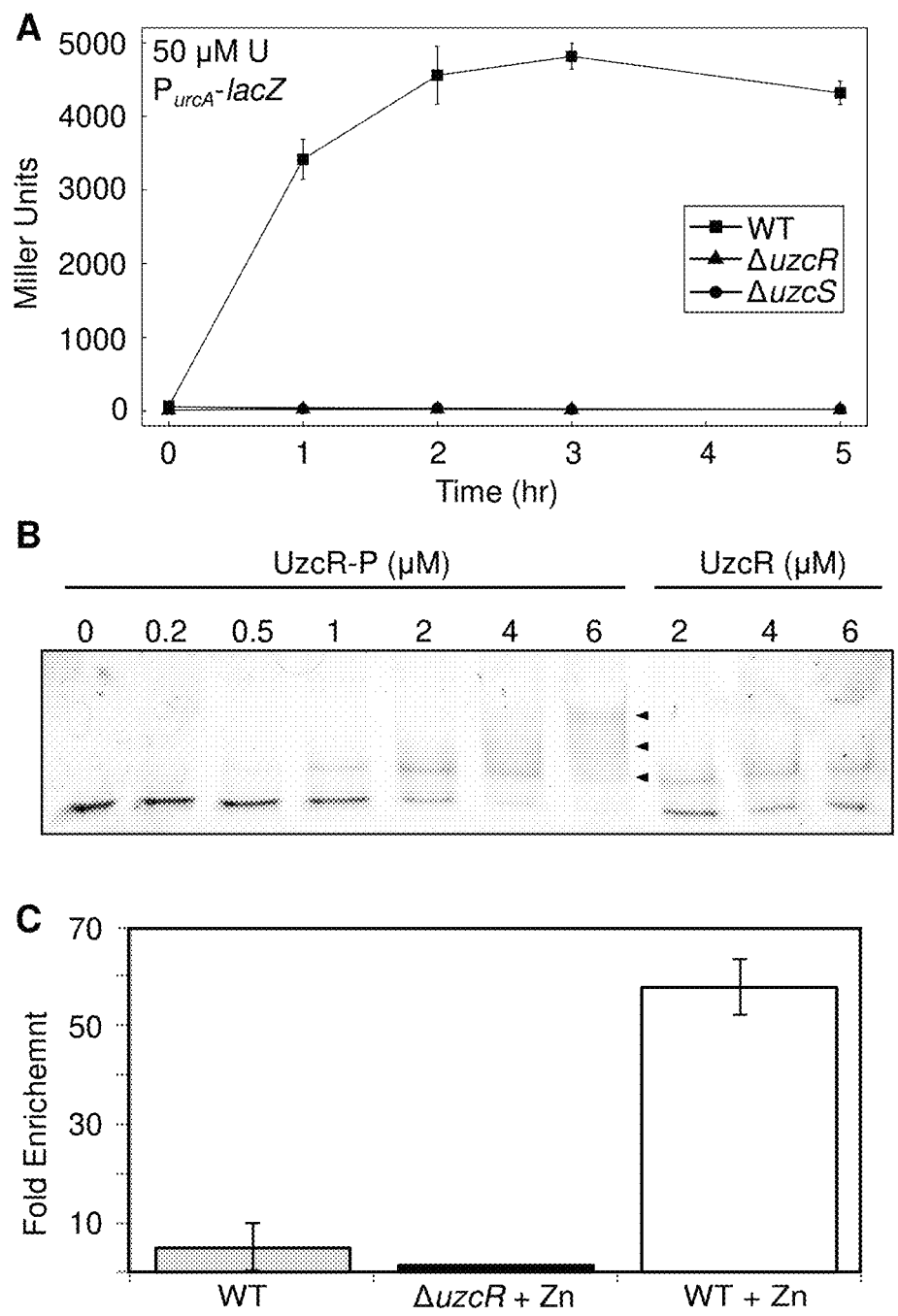
FIG. 24 shows an exemplary direct activation of $P_{urcA}$ by UzcRS according to some embodiments herein described. Panel (A): Time course of $P_{urcA}$-lacZ expression following treatment with uranyl nitrate in M5G media supplemented with 5 mM glycerol-2-phosphate as the phosphate source media for wild type (WT), ΔuzcR and ΔuzcS. Panel (B): EMSA assay of UzcR binding to a 5' 6-FAM (Fluorescein)-labeled urcA promoter fragment. UzcR-P was phosphorylated with carbamoyl phosphate and the concentrations indicate the total UzcR used in the assay. Arrows depict shifted complexes. Panel (C): In vivo binding of UzcR to $P_{urcA}$ using ChIP-qRT PCR. Data are plotted as the fold enrichment at $P_{urcA}$ relative to the control region (sodA) for wild type (WT) with or without 40 µM Zn and ΔuzcR with 40 µM Zn.

Example 5: Engineering of a U-Sensitive Genetic Circuit Comprising an 'in Parallel' Bacterial Two-Hybrid System AND Gate This Example describes the engineering of a U-sensitive genetic circuit comprising an 'in parallel' AND gate that utilizes the bacterial two-hybrid system [117]. In such an embodiment, the alpha-gal11P fusions and lamda repressor-gal4 fusion are expected to be driven by a combination of $P_{phyt}/P_{1361}$ and any UzcRS regulated promoter (see FIG. 22).

Example 6. Identification of a Putative U-Sensitive Transcriptional Regulatory DNA Binding Site in $P_{phyt}$ and $P_{1361}$ Promoter Sequences Using a bioinformatic approach, a putative regulator binding site was identified in proximity to the transcription start site in $P_{phyt}$ and $P_{1361}$ that is comprised of two direct repeat elements (e.g., CGTCAGC (SEQ ID NO: 202)); FIG. 7 Panels A and B). This binding site is conserved amongst Caulobacteridae Bradyrhizobiaceae, Sphingomonadaceae, Hyphomicrobiaceae, and Rhodobacteracea, facilitating a phylogenetic footprinting approach to construct a putative regulator DNA-binding motif (FIG. 7 Panel C), using 26 DNA sequences of $P_{phyt}$ and $P_{1361}$ from *Caulobacter* sp. Root342, *Phenylobacterium* sp. Root700, *Caulobacter crescentus* NA1000, *Caulobacter* sp. Root1455, *Caulobacter* sp. Root487D2Y, *Paracoccus* sp. 228, Caulobacteraceae bacterium OTSz_A_272, *Novosphingobium* sp. AP12 PMI02, *Hyphomicrobium* sp. MCi, *Hyphomicrobium denitrificans*, *Brevundimonas* sp. Root1279, *Sphingopyxis* sp. Root1497, *Afipia* sp. P52-10, *Caulobacter* sp. Root342, *Hyphomicrobium denitrificans*, *Sphingobium* sp. YBL2, *Sphingobium baderi* LL03, *Sphingobium indicum* B90A, and *Roseovarius indicus* strain DSM 26383.

Figure 9:
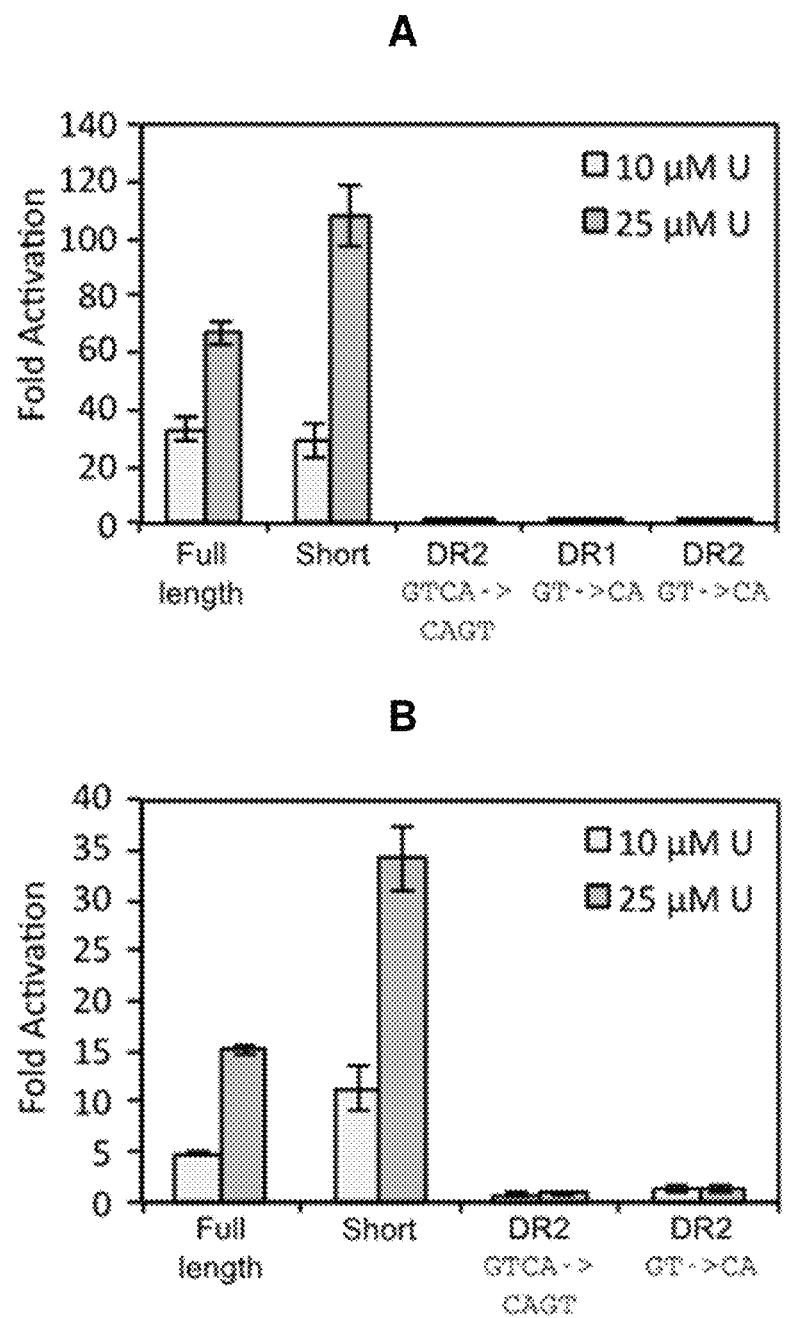
FIG. 9 shows graphs reporting quantification of exemplary fluorescence levels of $P_{phyt}$-gfp (FIG. 9 Panel A) and $P_{1361}$-gfp (FIG. 9 Panel B) variants in response to U at 10 µM or 25 µM in the host organism *C. crescentus* NA1000.

The functional role of the putative regulator site within each promoter was tested by mutating conserved nucleotides within each direct repeat away from consensus, as shown in FIG. 8 Panels B, C, D, G and H. Mutations within either direct repeat abrogated U-dependent activation of both the $P_{phyt}$ and $P_{1361}$ promoters in the host organism *C. crescentus* NA1000 suggesting that the U-responsive regulator is natively a transcriptional activator (FIG. 9 Panels A and B).

$P_{phyt}$ (but not $P_{1361}$) also contains a large tandem repeat (TR; 32 bp) located further upstream from the putative regulator site (FIG. 8 Panel A). To test the function of this TR in U-dependent induction of $P_{phyt}$ the size of the $P_{phyt}$ DNA was reduced from 238 bp to 81 bp, eliminating the TR and all upstream DNA (FIG. 8 Panel C). The data shown in FIG. 9 Panel A indicate that the TR is not required for U induction. Similarly, a shortened version of $P_{1361}$ that included only nine bp upstream of the regulator binding site (FIG. 8 Panel I) retained U-dependent regulation (FIG. 9 Panel B). Collectively, these data indicate that the DNA sequence extending beyond the regulator binding site within $P_{1361}$ and $P_{phyt}$ are not required for U-dependent activation.

To create a synthetic uranium repressed promoter, the consensus direct repeat UrpR binding site can be integrated within a promoter region, such that UrpR DNA binding will interfere with RNA polymerase binding and/or transcription. The UrpR binding site should be integrated at a location that overlaps, but does not alter the sequence of the −35 and/or −10 promoter elements or the TSS; disturbing −35 and/or −10 promoter elements will yield a promoter with low basal activity. Ideally, multiple locations will be tested to optimize results. While this promoter can be used to control transcription of any biological reporter, destabilized gfp (e.g., GFP-LVA [159]) is expected to yield the best results given the enhanced degradation rate. Highly stable reporters (e.g., GFP) will require several rounds of cell division to observe a uranium (e.g. UrpR) dependent decrease in reporter activity.

Example 7. Signal Amplifier Module

A positive regulator protein UzcY, encoded by CCNA_03497, was identified, which functions as a "natural" signal amplifier for the UzcRS system. Under normal growth conditions, uzcY is repressed by the MarR family transcription factor (CCNA_03498), and thus has no effect on UzcRS activity. However, when UzcY expression is induced through relief of CCNA_03498 repression or by ectopic expression, it stimulates UzcS activity through a direct interaction, causing a hypersensitive output in response to the metal inducers U, Zn, and Cu. This has the effect of dramatically increasing the output signal amplitude in response to low U (or Zn/Cu) concentrations, thus increasing sensitivity, and lowering the U detection limit of UzcRS by over 4-fold (FIG. 12).

To enhance the sensitivity of U sensors, this "natural" signal amplifier module can be integrated into U sensor circuitry. To accomplish this, in an exemplary circuit the U-specific promoter $P_{phyt}$ or $P_{1361}$ is used to drive expression of uzcY (e.g., see FIG. 13) such that UzcY levels are modulated in a U-concentration dependent manner. The low U detection limit of $P_{phyt}$ and $P_{1361}$ (~500 nM) is expected to allow signal amplification at environmentally relevant U concentrations, which is expected to improve U sensitivity and lower the detection limit in view of exemplary data demonstrating that both of these properties can be achieved with the native UzcRS system (e.g., see FIG. 12). Additionally, by restricting UzcY-mediated signal amplification to conditions of U exposure (e.g. by placing UzcY under regulatory control of a U-selective promoter such as $P_{1361}$ or $P_{phyt}$, the selectivity for U is expected to be further enhanced.

Example 8. Combination of 'in Parallel' and 'in Series' AND Gate Circuits

An example of combining 'in series' and 'in parallel' AND gate circuits within the same cell to enhance selectivity is shown in FIG. 14. An advantage of this exemplary circuit is that the UzcRS input is U selective whereas in the original 'in parallel' circuit as shown in FIG. 6 Panel B, the UzcRS-regulated promoter $P_{urcB}$ is cross-reactive with Zn and Cu.

Example 9. Negative Regulators of UzcRS

Figure 27:
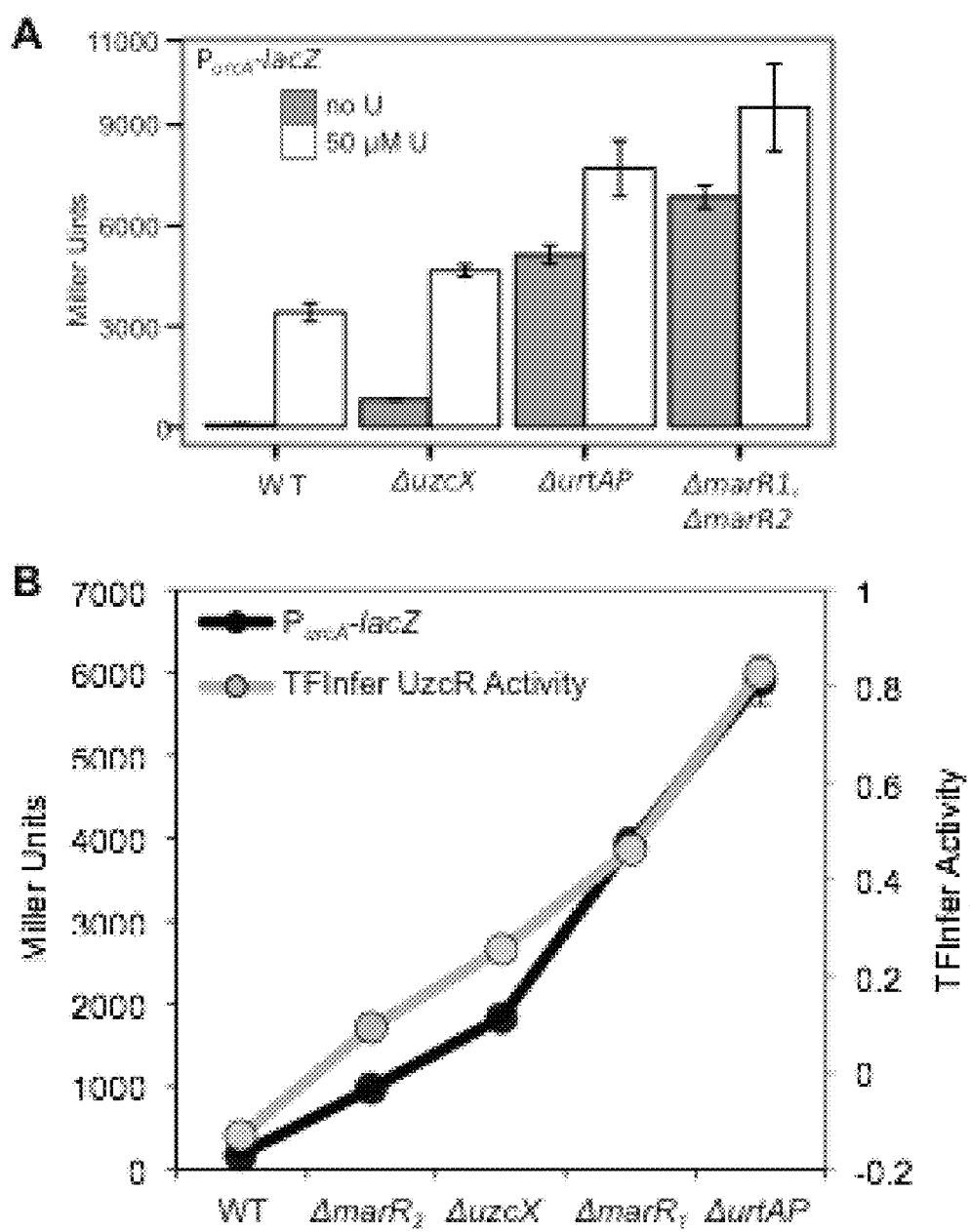
FIG. 27 shows exemplary effect of UzcRS regulator mutants in minimal media and U induction and TFInfer activity of UzcR in negative regulator mutants according to some embodiments herein described. Panel (A): Genes containing transposon insertions that led to high basal $P_{urcA}$-lacZ activity were deleted and the resulting strains were transformed with plasmid-borne $P_{urcA}$-lacZ (pNJH123). Cells were grown to mid-exponential phase in M5G supplemented with glycerol-2-phosphate, washed once with fresh media, then resuspended in fresh media containing 50 µM U. β-galactosidase assays were performed following 1 h exposure to U. Error bars represent the standard deviation of triplicate measurements. Panel (B): The activity of UzcRS was inferred from the log 2 fold change values for 37 UzcR regulon members determined in each mutant relative to WT. $P_{urcA}$-lacZ expression data from FIG. 1A is plotted for comparison.

The following four different negative regulators of UzcRS that are encoded in the *Caulobacter* chromosome were identified (see FIG. 27). None of these regulators are required for U sensing by UzcRS, however, their levels modulate the sensitivity to U.

Negative regulator 1: CCNA_03681 and CCNA_03680 encode an ABC transporter ATPase and an ABC-2 family transporter fused to a C-terminal aminopeptidase N domain, respectively (urtAP). Together these proteins form an ABC transporter with a C-terminal aminopeptidase domain.

Negative regulator 2: CCNA_02866 (also referred to herein as uzcX), encodes a membrane protein of unknown function that is located within a prophage region of the genome and part of the UzcR direct regulon (~8-fold activated by UzcR (Park et al., 2017) [3].

Negative regulator 3: A MarR family regulator CCNA_03498 that represses expression of an operon containing CCNA_03497, CCNA_03498 and CCNA_03499 (see FIG. 26). Expression of CCNA_03497 (occurs when repression mediated by CCNA_03498 is lifted) hypersensitizes UzcS to metal inducers.

Negative regulator 4: A second, paralogous MarR family regulator CCNA_02289 that represses expression of an operon containing CCNA_02291, CCNA_02290 and CCNA_02289 (see FIG. 26). Expression of CCNA_02291 (occurs when repression mediated by CCNA_02289 is lifted) hypersensitizes UzcS to metal inducers.

Example 10. U Biosensor Having U-Neutralization Output

This Example describes a U biosensor having exemplary U-neutralization outputs in response to bioavailable U.

Figure 21:
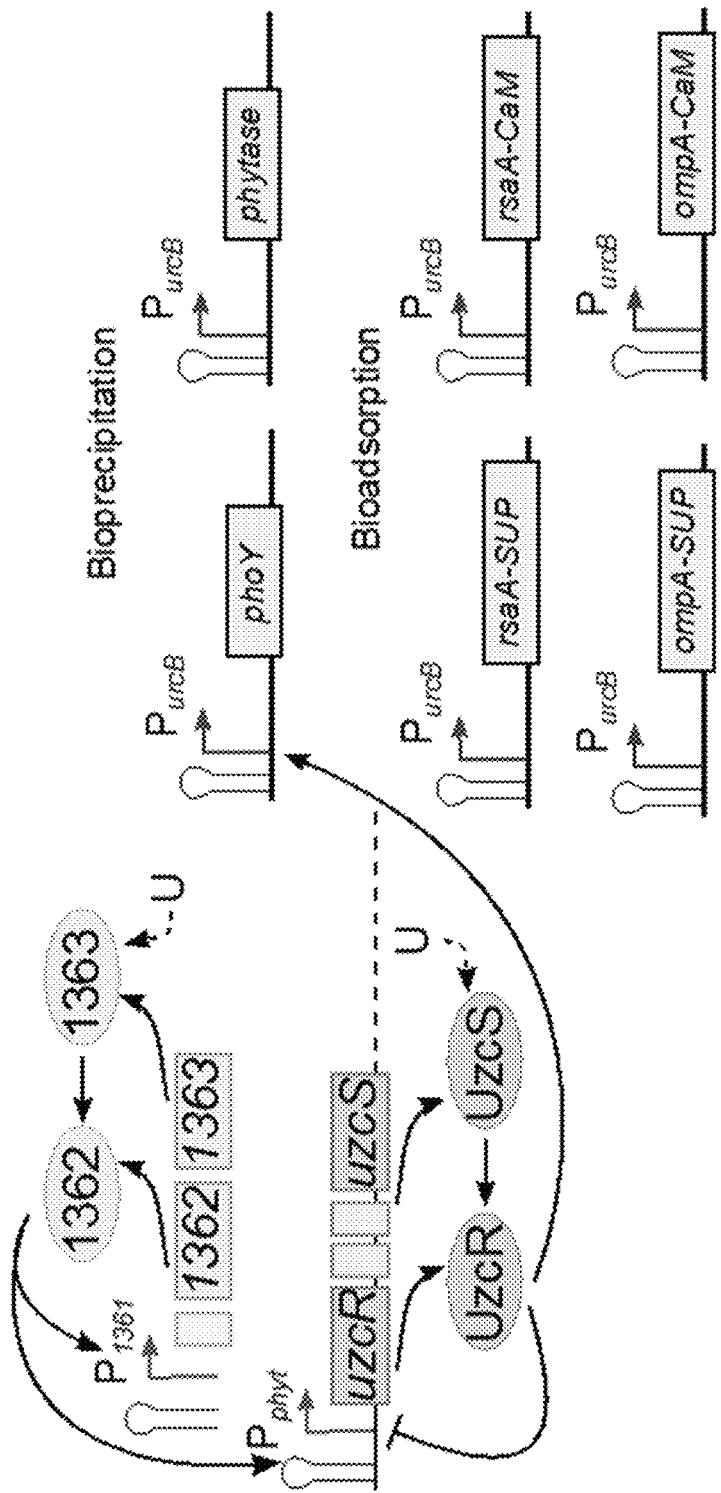
FIG. 21 shows a schematic showing exemplary U-sensitive genetic circuits having exemplary U-neutralizing outputs to allow U bioprecipitation or bioadsorption.

FIG. 21 shows a schematic showing exemplary U-sensitive genetic circuits having exemplary U-neutralizing outputs to allow U bioprecipitation or bioadsorption. In the exemplary U-sensitive genetic circuits, an exemplary AND gate comprises a $P_{phyt}$ promoter configured to initiate expression of UzcR and UzcS in presence of bioavailable U, and a $P_{urcB}$ promoter (activated by UzcR) configured to initiate expression of exemplary U-neutralizing genes phoY or phytase (to provide a U bioprecipitation output), or fusion genes of rsaA-SUP, rsaA-CaM, ompA-SUP, or ompA-CaM (to provide a bioadsorption output).

Example 11. UzcR Regulated Promoter

Table 7 shows a list of UzcR regulated promoters. Bolded regions are putative UzcR m_5 sites and single boded nucleotide is TSS.

TABLE 7

Exemplary UzcR regulated promoters

| Promoter | Promoter sequence | SEQ ID NO |
|---|---|---|
| CCNA_03 906 (PurcA) | CCCTTTGCAAACCATATACTCAAACGACCCAAGCAATATGGTCAC AAAAACTTCAAACATTACAGACTGTTTAGAATATTAAAGCCCC GTAATTCTCTTAATTACGCGTCATGACTGAGGTGTAACGAGACT TCGCGAGAACCCGAATGTATCCAATATTCATCGGCGCAGCGAAC AGCGCCCAGCCAGAGGGATACTTCA | 84 |
| CCNA_01 185 (PurcB) | GAAGACCCAAGTTTTGCGGTTAATCATTTACGAAGACTGGGCGGG CAGCAGCCCACTCCCAAGCGCCCACCAATTATGACTTCTTTTTC ATAGACTTAATTCGACGTCATGAAGCAGTCGTAACGGGTGTTCG CCATCCGACCGCTCTACATCCTCGATCAACGGATCGCCAAGCGAC CACCCAAACCGAGGATCAAGACA | 85 |
| CCNA_R 0078 | ACCTGCGCCTGGGCCCCACGGCGGACGGGTCGCGGCCCGGCGCC ACCTTGCAAAGGTTTAATCCACCTGTCCGGCTTGTAACTTCCCTCA AGGGGAGCCGAGAGGCACCGTCGAACCCA | 86 |
| CCNA_00 224 | GGAGCGGCGGTCTCAGAAAGGTGGCGAAAATAAAGCACTGATCA TAAGTAAATCGCGATCATCCAAGTAATGACGCCGGGCAATCGATT GTAGAAAGATGAAAATCTCGTAATGCTATCGGATATGTAATCTA CATGTCAGGCTTGTAACTTGAGATGAATGTTCGGGGCGTTCAGAC CTGTCGCCACTGAGGGGAACCAG | 87 |
| CCNA_03 098 | TCACGCGTCTTCATGGGGCTGCTCCTTGCGACATCGGCGACGAAA CACGCCGTAGACGCCCAGATGGGGGTCGCCCGGAGGCGCGACAA TGGTCGAACCGCATCACCGGGGCAGGCGCCGTGAAGATTACAGT CAATTAAATTGAACGCCGTTCTTCCTTTTCGGAAAGTGCCTTGGG AACTTCCGGACCGAGGGACGTGG | 88 |
| CCNA_00 858 | CAGACACGCGGCGGTTTCCGCGACGGAAGAGTGTCGAGGCGGGC GCATACGCCTGTGGCGCGAATGCCACTTGGAGTCCCTCACCCGCA ACATTGCCGAAAAGAAATTTGTCCCGGCGCGTCGGAGCGTCTTT ACGGCTGGGGGTCGAGACCGCGCGGACGTCCGCAGCGTATCGCT CGACACTTGAAGTTGAGGTCTCCC | 89 |
| CCNA_03 762 | ATGCAGGCCGCCTCAGGGGACAAAGTTTCTCACGAAACGGCCTTG TGCGATCACATTACACCGCTGTAACCTCGATTACGCGCGTCAAC GTTCCTTAAATCGGCGTCATGAAGCAAGAGTAACGTGTAATAAC CATGGGCGGACCTATATCCCTCTCATCGGACGCCAACGGGGCGG CCGAAGAAAAAGGGATCAAGAC | 90 |
| CCNA_02 172-02174 | TAACCAGACCGCAAGGCGCCTAAGTCATAAGCCTCTTACCGCCGA GGCCGCGCGCCGGCTGGCGAGCGACGAGGTCTGCCCTTCAGCGA GGCCGGCCCCGACTATTTCATGCCTGAAACGCGCCTTACCCCGA TTTAACTTGGCCACTCGTCGATCGGCGTTCATTGCTGCAACCGTC GATTGGGGGAGCACGAGTCCGCA | 91 |

TABLE 7-continued

Exemplary UzcR regulated promoters

| Promoter | Promoter sequence | SEQ ID NO |
|---|---|---|
| CCNA_01968 (P1968) | GCGGAGATGGATCGCGCGACGGGTCTGAAACAGAGTCAGTTGAG CCAGGCGTGCGGCGATGACTCCACGTTGTTGCCCCGCGGACTTTC CATTCCGCGCTGCCGTTAAATCCCCGTCATTACCGCAATTTAAGT GGTCTCTGGCCCTCCGTCGGTCCAAACCGTAACTCACACAGTCGC GTATGGACTGAACGGAGTAGTC | 92 |
| CCNA_03396 | ACCCTTATGGCATCGGCGGTGGATCCGCGCCTCTTGAAGGATGAC CAGCATGCGGATGCGCGGCTGGAAAAGCCGATCACCCCTGGACG TCTTCTGCAGACGGTGCGCGCGCTGGAAAGCCGCCACGCAGCCGT GACAGAACTTTAAGCTGACCCCGACCACTTCGCGCCCCTAGGGT GTGACGCGTTTTTGGGGAGCTCAC | 93 |
| CCNA_02758 | GCTCGACCCGGCGTTCGCGGCGGGGCTGGAGGCGGCGGCCAAGG CCGGGGTGGAGGTGCTGGTCTATGCGTGTGAAATGGGGACGCAG GCGGTGCGGATCGCGCGGCGCATTTTGTGGAGCCACGCCCACCT AACAGCGATTTAAGCTGCATTTCGCGCCCGCTGAGCTAACCCTT CTGCAGGCTCGCGAAATGGGGATCG | 94 |
| CCNA_01551 | GAAAGAGTGTTCAGGCGCAACCTGGGGGAAGGTCCCAAGGCCTA GACTGGCACCTAGGGCCGAGCGACGCTTGCGACAACCGTCGGAA TTCTAAGGGTGCTGTCAGATGTCGTGGAGCCCCCTTGCAAGACCA TCGGCCCTTCATGACCAAAAGTTCACTCGCCTGCTTTGCGAAAT GCTCGCATAACGCCGCTATGGGAT | 95 |
| CCNA_03997-CCNA_03786-03788 | GGTTCGCCGCGCGATCGCATGGCGTGACGACCATGACTAGAGGG GCCAAGCGCCAGAACCTGTCAGCTAAGCCGCCCAGCGACGCCGA ACGCCGTTACCGCGATGGGGCAAACCTGTAGAATTGTTCATGAAC CCGGACATTTTCGCGCCATAACCGCGTGGCCAAGCTCCAGGCTCG GACTACGACAGGGAGCTCACAAC | 96 |
| CCNA_00147-00149 | CCTCGATGATCGCGACCGACCCCTCCACGGCCTGAGTGTGCGCCG ATAGCGCGGGCGACACGCCGCCGCCGATCATTGCCAAAGTTTAA TATCGTTTCTCGATAAACGACATTGGCGGAACCGCAAACCCGGCC TATCTGTTCAGTGTGGCGAAGGGGCGAATGTTTCGGCCCTGGCCA TGTCTCTCAAACTGGAAAAAGC | 97 |
| CCNA_03324 | TCGTACGGCGATGGTCGATGTGCATGGCCAGTTGGATGAAACTCG CTTGCGCCTTGGCGTTAGGACCCGCATGGGCGGCTCGCTCAAGCC GATCGAGGAAACCACGCGTGGGTTGAAGGAAGTCGGCTGAGCAA CGATCAACCGGACATTGCGATAGTTTAATAACCTTGGGCCTCTA ATTTAGGTTAGAGGCCCAAGTCA | 98 |
| CCNA_01303 | CTCGCGACGCTCGCTCGCCGCTATCCCCGGCTGGGCGCGGCGCTG GGCCTCGGCTTCGGCCTGGTGGGTCTGGCGATGATGGTGGACTAG CCTGACCCCAACATGACTTCGCGGTCATGACCTCGAATTAAGTC GAAACCTTGTCGGCCCCTCGGTAGCCTCTCCTCATCGAATTTCAA CACGCGTCCTTGGGGAGACACT | 99 |
| CCNA_00913-00911 | GGTACGAACGCCGCGGCTACCGCCTGACCGGCGAAACCCAGCCC TTCCCCTATGGCGACGACCGCTTCGGCCTGCCGCGCAGCGGGATGAT CTGGCGTTCGTGGTGATGGAGAAGGGGCTGTAGGGCCCCATTAC CGAACCTTAAGTAGCTCCGTCCGGGCCGACGCGTTCAGATGCCG CGTCTTCGGCTCAGGGACTCTCCA | 100 |
| CCNA_03699 | CCTGACCGATCGGGTCTATGACTGGGTCGCCGCGAACCGCTATCG GATCTTCGGCAAGCATGACCAGTGCCGGATCCCGACGCCGGCGC AACGGGCGCGCTTTCTGATCGACTAGCCCCGCCCCTATATGAACT CTCGGTAAGGTTTCCCGGCGAACCGGCGGTGCTAGGGTCCCGCGC AAACATTCAGGAGACTCTCGCG | 101 |
| CCNA_02196 | GTCGTGGGCGCTGATCATCTCCGGCTCGGTCGTCTATGCCGGAAT CTACCTGCTGGCGCTGGCGCCGGTGGGCAAGAGCCGCTGGGCGC GCCGCTGGCAGCTTCTGAAGTAGGGCGGTGAATTCGGCGTAATC CGCGTCGAATCCCCTTCACAGCGACGCCTTGCGGAGCCACCTCTA GGGTCTCTTCCTGGGGCAGCACA | 102 |
| CCNA_01521 | CTGCATGGCGCGCTGCTGAAAAACGAGCAGGACGTCCATCTGTTC GAACGTCTGGCGTTCCTCGCCCGCCGCGAAGGCTCGGGCACTCGT CCGGGCCAGTAAGGCGTCTGCGGCGAAACGGCCGTTACCGGGA TTTCACTGGACGCGCGCCAGACGCGCGGCCACCTTCCCGCCCATC AGGGGACGGCCGAGGAAACACCA | 103 |

TABLE 7-continued

Exemplary UzcR regulated promoters

| Promoter | Promoter sequence | SEQ ID NO |
|---|---|---|
| CCNA_01379-01380 | GTCGGCCGTCGCGCCGCGTTCGACGCTTCGCCGCCGCTGCTCGCC GGCTTCGAGGCTGAGACGGGCTTCAGCTTCTGACGATCTGGGCCC GATGGACCGTCGCAACGTTTGCGTGAAAAAAGCTTAACTGGCGA CGACTGGCGGAGCGACTTACACGCGATCATATTGTGGCCGGCGC GAGCTTCGCGTGATTGGGGATAG | 104 |
| CCNA_01335-01334 | ACCAGGGACAGCAGGCGGCGCAGGATCATCTTCGGGCTCGACTT GGAACGACGGTTCCAGCGGTCATCCATGGCCCAGATTGCAGGCGT ATGACGACCGGCGGTCTCCGAGGCATGACACCCTCTTAACTTGG CGTGGGCGGGCGCTCGCCATAGTCTTCGCGTCGAGTCGACTCA GGTCGGCGTCCGGAACCGCTCCA | 105 |
| CCNA_02866 | TGCAGCCGAACGCCAGGCGCGCGGGCAGGCGCGCCTCATGGAAC TCGCTCATCAAGCGATCCTTCTGGAAAGTCGAGAAAAGGTTTGAG GAAAAGCAAGACGGCGCTTAGTCGACGCATTAAGACGACGTCATGACCCGCTTTTCACTTCTTGCGCGGGACATCGGTCTCTAGGTT AGGGATCGAGATTGGAGACCACGA | 106 |
| CCNA_R0100 | GAAGAACAGCGGATTCTTAATTCGCATCCATGAAAGGGCCCCGC AGCGATTCGCCATGGICTCGCCACAGAGIGGCGGCGAGCTTGGC CGCG | 107 |
| CCNA_00851-00849 | GGTCTCGTCAGTTATGGAAGTCCTGTGCGGCATTACATTTCCGTT AGGTCAGCCAAACGCGCGGCGCCGGAGGTTGACTTGCGACACTC CAGCTCTTATGTCCAGCCCACATGAGAATGAACGTTCATTCTCAA ATCGTTCATCATAGTGGCCGCGTCAAGGGTAAGAGCCCGCGCGAC CCTCGCCTCCCGGGGTCAAACA | 108 |
| CCNA_03619 | AACCCGGGCAAATCCTTTCCCGGCCCGGATCCCCTGCAAGGCCGC CGCACGTTCCCCAACGTCGGCGGCCTTTTTGCGTCGCTTCTCGCGC CGAGGCCCGACCCGCCCTGTAAAAAATGGGTCACATGAACTTTT TTTAAGGGGGTAAAGTTTTCGCGCCGTTGCAGATTGCCGGCGGCT CACACCAACGGATGCGAATTC | 109 |
| CCNA_02933 | CCTGGCGATAACGCCGGTCTTCGCGCCAAAACCTGCCCAAGATTA CAAAACGTTCAGACTCCCCCGTCTCGACAAGCTGTCACAGGCTG GACATGGTTCGCCGCCGTCGCGGACTTGGGGGTCTGCGGTGCGGG GATTGGGGCGGTCGCGCCTCCAACACCAAACATAATTTTGGCTAC ACGCCCGAGGAGCGTCTCAAGT | 110 |
| CCNA_02597 | CGGCCGCCTAGCAACAGCGACGCTCCGGGAGTTGGTCGTCGTTCC ACCCTATGTGATCCGCTATTATGTGGCTGACGGTCTGGTGCATAT CGTCCGCATCCGGCACGCCGCCCGGTTGTGACTTTTTCGTAATTCATCCTGGGTTCAGGCGGCGAGCGGTCCTCTCACGGTCAAGCTGA CCAAAAAGAGGGGACACCAGCA | 111 |
| CCNA_01139 | AAGGACGCCGCCGAGCAGTCAGGGACCTATCTGGCGACCTGGAA GAAGGTCACGGGCCAGTGGGTGATCGAGAACGAGCTTTTCGTGA CGCTGGCTTGAGCGACGGGCCTCTTCCCAGCGAGTATGACGCGG AATTAATTAAGCCCAAACAGGGGCGGGGCTTACGCCTTCGTCCTT CAATGCGCCTCTGGGGAGGAAAAC | 112 |
| CCNA_03816-03814 | CGCCTGGGGCAGACGCTGCACGAGGGCGCGGTGGACCGAGAGGC CGCCCACGCCAGAGTCAAAGACGCCGATCATGGGCCAAGCTGTA GCCGCCAAAGCGGGGCGCGTCCACGCACTGGGGAAGGTTACAGT CCTGTCATGTGACAGGTCGGCCGCCCATATCCTAGGGTCACGGC CAACACTTTCACCGGAGATCCTCCG | 113 |
| CCNA_02588 | GCGACCAGGCGGGCTTCGAGCGCGGCGTGAGACATGGGCACGGG ACAGCTACTCCGATCCTTCAACGACCTATGTGACCGGGATTCCTT AAAAACGCCATACCCCGGGCCCACAGGTTACAACCCTAGTTATA AAACCACTCATCGTTATGACCGAGAATTAATTGAATGTGGCGCC CGCTCCGGGCCATGTAGCGCCCA | 114 |
| CCNA_02218 | GGCGCCGTATCGGCCGCCAAGCGGAGCCATAGCCACTCGAAGCG CGTTCGGCTCCTTGGCGGTATTGGTGCGGGCTCTCGCCGCATTGC ACTAAAGTCATGTGAACGATCATTCTCATTGTGCTAGAAGCGCG GAATGAGGTGATCCGGTCGCTTTGTCGTGCGTATCTCTCCTGTCCG TTGCTGGTTTCGAGGCGACCCA | 115 |

TABLE 7-continued

Exemplary UzcR regulated promoters

| Promoter | Promoter sequence | SEQ ID NO |
|---|---|---|
| CCNA_03097 | CGTCATCGCCATGCCACGTCCCTCGGTCCGGAAGTTCCCAAGGCA CTTTCCGAAAAGGAAGAACGGCGTTCAATTTAATTGACTGTAAT CTTCACGGCGCCTGCCCCGGTGATGCGGTTCGACCATTGTCGCGC CTCCGGGCGACCCCCATCTGGGCGTCTACGGCGTGTTTCGTCGCC GATGTCGCAAGGAGCAGCCCCA | 116 |
| CCNA_00419 | GTCGTCCTGCAGCGTCGGCGGGACGGCGGTGTCTGGGGTGGGGTC GGTCACGGTTGAGCCTGGAATAGTCTTGTTATCCAGATCGTCGCG CTGATCAGGCCGTGATGCAAATGAAGGTGGCGTCATGAAGGCG ATGTCACGTTGGGCGCGTCCGCCGGACCTTACAAAAAAGTCATC TCCTCGGATCGATCCGGCGCCGACGCCGGGCCGTAATCATCATCA GACCGCGCGCCGTCGACCGCTTCAGATCCCCCAACCCGAAGACTT GATGGAAGGTTTCAGACAATGATGCGTTCGATGC | 117 |
| CCNA_00417-00416 | GTCGTCCTGCAGCGTCGGCGGGACGGCGGTGTCTGGGGTGGGGTC GGTCACGGTTGAGCCTGGAATAGTCTTGTTATCCAGATCGTCGCG CTGATCAGGCCGTGATGCAAATGAAGGTGGCGTCATGAAGGCG ATGTCACGTTGGGCGCGTCCGCCGGACCTTACAAAAAAGTCATC TCCTCGGATCGATCCGGCGCCGACGCCGGGCCGTAATCATCATCA GACCGCGCGCCGTCGACCGCTTCAGATCCCCCAACCCGAAGACTT GATGGAAGGTTTCAGACAATGATGCGTTCGATGC | 118 |
| CCNA_02914-02917 | AAGGACGAGGATTTCCAGCCGGCCTCGCGCCGAAATCTTGGCGA CGAAGCCTTTTCCCCGGGGGAAGGCACGTTTGCAGCCGGATCGGT AGCGAAATGCGTCACGCGTGCAAACACCGCGCGCTGAAACATTA CATCTGAGAAATATTTGACCTCAGACGCCAGTCTGCGTCAGAAC TTCGCTCGCGTGAGATTCCGGCCGATCCGGAACGGGCGAGACCGT GCCCCAATCGCGGGCCACTGGGAGGAGAGACCTTGGATAGACGA CAGTTCCTCGCGGCCTGCGGCATCGGCGCCGGGGG | 119 |
| CCNA_00976 | CATGCGAAACGCCAAGCGCCGCTTTCGCGGCGCCGAGGGCTTTGA TTTTAGAGGATTTTCCCGCCTCTGGCTGGCGGGGAGGAAATGGTC GGAGTGGCAGGATTTGAACCTGCGACCCCTGCGTCCCGAACGCA GTGCTCTACCAGACTGAGCCACACTCCGACTTGGAGGCCGGCCTT ATAGGTGGGTGTTCCGGGGGCGCAAGCGCCTTTTTGCAGGTTGG TCGGGAGGCCTGAAAAAAGTTCTGAAAAGGTCGTTGCATCCATCC GAGTCGTGAGCTATCTCCACCGCCTCGCCGGG | 120 |
| CCNA_03893-CCNA_01721 | CGCGCCGGTGCTGAACGTGCTGATCGGCGCGCTGGCGCCGGGTCT CGCCCCCGCTGCGGCGGCGCTGGCCCTGGTGGCGGCCACGCTGCT GGTCAGCAGTCCCTCGGCCGGCGACTGGGCTTGGCCGCCGT TTAGCGCCTTACGAAAGTTTCATGGCGAGCGGCGCCTCCAAACG GGGCGTGAGCGCCTCTTACCAGTGAAGGCGGCGCTGTGGCGTC GTTCACCGAACTGGAGGATTTGAGAATGGGTCCCGAAATCATCGT CCCGGTCGCGCTCTTCGCGATGATCTGCGCCGT | 121 |
| CCNA_03456 | TTCTCGTGGCGCGCCTGCGCCGAGGAGTTCTTCCGCAACCTGCAG CCCTATCCGGAACCGGAAAAGACCCGCTTCTGGCGCCGGCTGCGG CGCCTGGCGCGCCTGCGCAAGAAGACGGCGGCGTAGTCGCTTCCT GTCCGCATTGTAATTGGCGCGGCGCGCAGACCTCGGATAACGCTG GTCTCTCGATAGGGAGGCGGCATGAAGCTCATCATGATCGTCAT GGGACTGTGTCTGGCGGTCAGCGCCGCCCAGGCCCAAACGAGCA CGCCCGCGCCCGTCATCGAGACCTACAAGACA | 122 |
| CCNA_03519-03521 | CGCGCATCGCTAGCCCTTGCCAAGCGCCAGAGCCCACGCGCTGAG CATGGGAACAGCCCGTAACCCCCGCCCCGAGGGGGTTCAGTCGC GAATGCCTCTCAGAAACCCCCGAATTCGGCGTCCGGATCATTAC GTATCATTCATGAGTAGGTACCTTGCACCACTCAGTACCGGGCG GTACAAGGGAGCATCAACGGAGGCAAGGACGCCGTGCCGGAAAC AATTGAAATCCAACTGAAGAAAGGCGTGCTGGCGCTCTGTGTGCT GGCTCTGCTCTCGCACGCCGACAGCTACGCCTACG | 123 |
| CCNA_01712-01710 | CCAGCACCTCCTCGGCCGGCTTGGGGCTGTCGGCCCAGAGCACCT TCATGACTTCGCTCTCGGCGCCGCTGATACGTTGTGATGTCGTTTC CATGAGCGAACGATTACGCACGTAAACGTTTCCGTCAAGTGATCG ATTACGCACGTAAACGAAATGTAATGCAGCGTTGGAGGCGTAAG CGAAGCGGCTTAACGCTCGAGAGCGGAGGAGTCGTACATGCCAG ACACGCTTCAGCTTGGCCTGCCGGGCCTTGAGTCGCCCACGCCGA CGGATCGGCTGATGTTCCTGCTGTATCCTGAC | 124 |

TABLE 7-continued

Exemplary UzcR regulated promoters

| Promoter | Promoter sequence | SEQ ID NO |
|---|---|---|
| CCNA_03195 | GCCCGGGACGATCTGGGTCGCCAGCCACAAGCCGAAGGCGGCGA TCAGCAGGCGAAAAATGAGACGGACCATGACTTCTCTCCAACTTC AGCCGCAACGCGTCCAAACCATCGCCGCATTCGTACAATATCCGA GCCCGAAACTCGGACATTACAAATGCGTTACCGCTCTTCAAACT GCCGCAGCGTGAACTATCTACCCTCCTGTGTGGGGGATGATCGCG CGCGATTGGCGAGCGGATCCGCACGCAAGGGGATATGAGTAAGA TGGCCGTGAATTCTCTATCGGTGATGTCGCCGGA | 125 |
| CCNA_03640 | CTCGTCCCCGATCAGGACAATCCGACCCTCGTGACCATACTGGCG CAGGAACGCGGCGACCGAGCCGCCCGCGTGACCCGCGCCGACGA TGACGACGCATGCGTTCTGATTAACTTCAGCGCTCAATGACGCCC TCCCTTTCGTCAAAAATGACGCCGGCGTCACCTATTGGCAAGCGC CTTCGACAGAGGCGGATACGGAATGGGGCGGCTCGTTTCCGAAG CCGCCCCACATTTATCGCTCTGCAGCGTGCGTCAGACGACGCGCT CGACCATCATCTTCTTGATTTCGGCGATGGCCT | 126 |
| CCNA_02421-02419 | TGAATAGTCCGCCTGGAGCTCGATAGCTCTCCCCCCCAGCGGACC CGCTTCGCTGCGCTCGACCCGTTACGCCCCTCACGAGGACCAGCC TCCAGAAGGATCGTTTCGAAGCGCGTGCAACCGACGCCCTTTTGG GGCTCCGGTCTTACCGCAATGTTAGAATTGCGGCTGGGGTCCTTT GGCAACCCCTTTTCGTACCGTCAAGGGTCTCATTTGGGCACAAAT TCATCGTCACGCCCCGCCCCCCTGGCGTTTGCCGCAGTGCACAA AACGGTTTTCCGGATTTCGGGGCGGTTTTTC | 127 |
| CCNA_00974 | GTTTCGGGAGCGGAAAATAGCCTAGAAAAAACAGCCTCATGTTT GTGAGCGCGTGCTGTTTTCGATGCTTGCGTATCCATATTGAGCAA TGATTTTCCGAAAAGCGTTCCTCCTGTGGCGATTTTGCGACAGGG GGGTCGGGATAATGATTACTTTTTTGCAATCAGAATTGACCCTCG CCCGATCCACCCCCTAACGTCGCTGCAACCGGAAGAGTTTGTTCC GGGACACATGTGATCGCGTGGTGGATTTACAGCGGATTTCGGCTC GAAAACGGACAGGTCGCTGAGGGGCTTCTTGT | 128 |
| CCNA_02370 | AGCCCGATTGGCAACCTGTCAATCCGTCAACTTGGGGGGATTTGC GCACCTAGCGCCCACCAGCATGGGCGATAAGTGGCGCAAAGAAG ACACACATCGCCCGTTTCGAGCCGCCTCGCCGCACCGAACGGTCA TCGTTTGCAGATTTTTGTGTTGATTACGGTCCGTTAATTTGCAGTA ATTTGCAGCAACGGCCCGCCGCATGACCTCAACAGCGCAGAGCC GGACAGGGAGGGAACTCGTATGAACACCCAATTTTCGCGCCGTC GCGCCTGGCTGATGGCCGGCGGGGCCACGGGCC | 129 |
| CCNA_02287-02288 | GATGACAAGGAAATAGCCGGCGGCCATGCGGTCGAAGGCGGTTT CAAAGGCGTTCAGCGTGCGGTTCATGATGGAAGTCCCTCATTTTG GCTTGCCCCGACCCCCTGTGGGTCATCGCCCTCGAAAGTTACGAG GCGATCTGGACAGTGCTTAGATAGCACCAATCTGAACGCCGTCAA GATGGTCTTTACAGCGTTTAGATGAAATTTTAGAAAGCTATGGTT AGAGTGAGGCCGATGAGCACAGCGACCGCCGAATCCCGCCCCTA TCACCATGGCGATCTGAGCCGCGCCCTGATCGA | 130 |

Example 12: Application of a Combinatorial Input Logic Towards U Detection

A combinatorial sensor approach using multiple regulators with broad specificity profiles can be adopted for the selective detection of compounds lacking specific regulators (e.g., butanol).

To apply the combinatorial input logic towards U detection, an AND gate circuit was developed by integrating two functionally independent, native U-responsive regulatory pathways into a single synthetic pathway in Caulobacter crescentus. Prior studies revealed that C. crescentus tolerates high U concentrations [160, 161] and exhibits a robust and specific gene expression response following U exposure. [160, 162, 163] Using the promoter of the highest U-induced gene, urcA, ($P_{urcA}$) to drive expression of UV-excitable gfp, Hillson et al generated a whole-cell U sensor that was responsive to sub-micromolar U concentrations and successfully detected U in a groundwater sample. [163] Subsequent genetic and biochemical analyses revealed that the majority of U-dependent gene induction in this bacterium, including regulation of $P_{urcA}$, is mediated by the TCS UzcRS, [153] supporting a role for UzcRS as a U-responsive master regulator. However, characterization of the specificity of UzcRS revealed strong cross-reactivity with the common environmental metals Zn and Cu. [3]

To improve upon the selectivity of the UzcRS system, the selectivity of a second U-responsive regulatory system (UrpRS) in C. crescentus was identified and characterized. Leveraging the distinct selectivity profiles of the UzcRS and UrpRS TCS and the tripartite GFP genetic framework, [164] an AND gate circuit that integrates signaling input from both pathways was constructed and characterized.

Example 13: Identification of the U-Responsive UrpRS TCS

Examination of U and Zn transcriptomic data [3, 160] in C. crescentus revealed a small subset of highly U-induced genes that are not regulated by UzcRS and only weakly induced by Zn (FIG. 1). Two operons (CCNA_01361-CCNA_01362-CCNA_01363 and CCNA_01353-CCNA_01352-CCNA_01351) were of particular interest based on several observations. First, both operons are highly induced by U in minimal and complex media, but lack induction by other known stress responses (e.g., DNA damage, heat shock, heavy metals; Table 8A to Table 8C).

lators. [169, 170] As such, the OmpR/PhoB-family response regulators CCNA_01351 and CCNA_01362, whose expression is governed by $P_{phyt}$ and $P_{1361}$, respectively, are potential candidates for the U-responsive regulator. Deletion of CCNA_01351 or the histidine kinase CCNA_01352 had no effect on U-dependent induction of either promoter (data not shown), consistent with the results of transcriptomics per-

TABLE 8

Fold change in CCNA_01361 and CCNA_01362 expression under various stress conditions

A.

| gene | Function | U - PYE | U - M2G[160] | Zn - PYE[160] | Cd - M2G[160] |
|---|---|---|---|---|---|
| CCNA_01361 | PepSY superfamily protein | 91.8 | 7.4 | 1.1 | no DE |
| CCNA_01362 | two-component response regulator | 103.3 | 9.7 | 2.3 | no DE |
| CCNA_01363 | two-component sensor histidine kinase | 74.4 | 7.7 | 3.4 | no DE |
| CCNA_01353 | myo-inositol-hexaphosphate 3-phosphohydrolase (phytase) | 115.1 | 5.5 | 2.4 | no DE |
| CCNA_01352 | two component sensor histidine kinase | 7.2 | 6.6 | 1.3 | no DE |
| CCNA_01351 | two-component response regulator protein | 4.4 | 9.5 | 1.6 | no DE |

B.

| gene | Function | $CrO_4^{2-}$ - M2G[160] | $Cr_2O_7^{2-}$[160] | $^2SeO_3^{2-}$[160] | C starvation (Britos) [165] |
|---|---|---|---|---|---|
| CCNA_01361 | PepSY superfamily protein | no DE | no DE | no DE | 2.9 |
| CCNA_01362 | two-component response regulator | no DE | no DE | no DE | no DE |
| CCNA_01363 | two-component sensor histidine kinase | no DE | no DE | no DE | no DE |
| CCNA_01353 | myo-inositol-hexaphosphate 3-phosphohydrolase (phytase) | no DE | no DE | no DE | no DE |
| CCNA_01352 | two component sensor histidine kinase | no DE | no DE | no DE | no DE |
| CCNA_01351 | two-component response regulator protein | no DE | no DE | no DE | no DE |

TABLE 8C

Fold change in CCNA_01361 and CCNA_01362 expression under various stress conditions

| gene | Function | heat shock (DnaK/J depleted) [166] | DNA Damage [167] | Fe limitation [168] |
|---|---|---|---|---|
| CCNA_01361 | PepSY superfamily protein | 1.0 | 1.1 | no DE |
| CCNA_01362 | two-component response regulator | 0.8 | 1.1 | no DE |
| CCNA_01363 | two-component sensor histidine kinase | 0.6 | 1.0 | no DE |
| CCNA_01353 | myo-inositol-hexaphosphate 3-phosphohydrolase (phytase) | 2.1 | 1.1 | no DE |
| CCNA_01352 | two component sensor histidine kinase | 1.8 | 1.3 | no DE |
| CCNA_01351 | two-component response regulator protein | 0.8 | 1.3 | no DE |

The operons are furthermore likely regulated by the same transcription factor based on the presence of nearly identical DNA sites comprised of two tandem direct repeats (5'-GTCAG-3'; FIG. 7A-B) with 11-bp center-to-center (ctc) spacing within the CCNA_01353 ($P_{phyt}$) and CCNA_01361 promoters ($P_{1361}$). This direct repeat site is conserved within the promoters of closely related alpha proteobacteria (FIG. 7C) and required for U-dependent induction of $P_{phyt}$ and $P_{1361}$; mutations away from consensus in both $P_{phyt}$- and $P_{1361}$-gfp fusions abrogate U-induction (FIG. 9A-B). The CCNA_01353-CCNA_01352-CCNA_01351 operon encodes a phytase enzyme that confers U tolerance [162] and an uncharacterized response regulator and histidine kinase pair, while the CCNA_01361-CCNA_01362-CCNA_01363 operon encodes a PepSY superfamily protein and another uncharacterized response regulator and histidine kinase pair.

Figure 17:
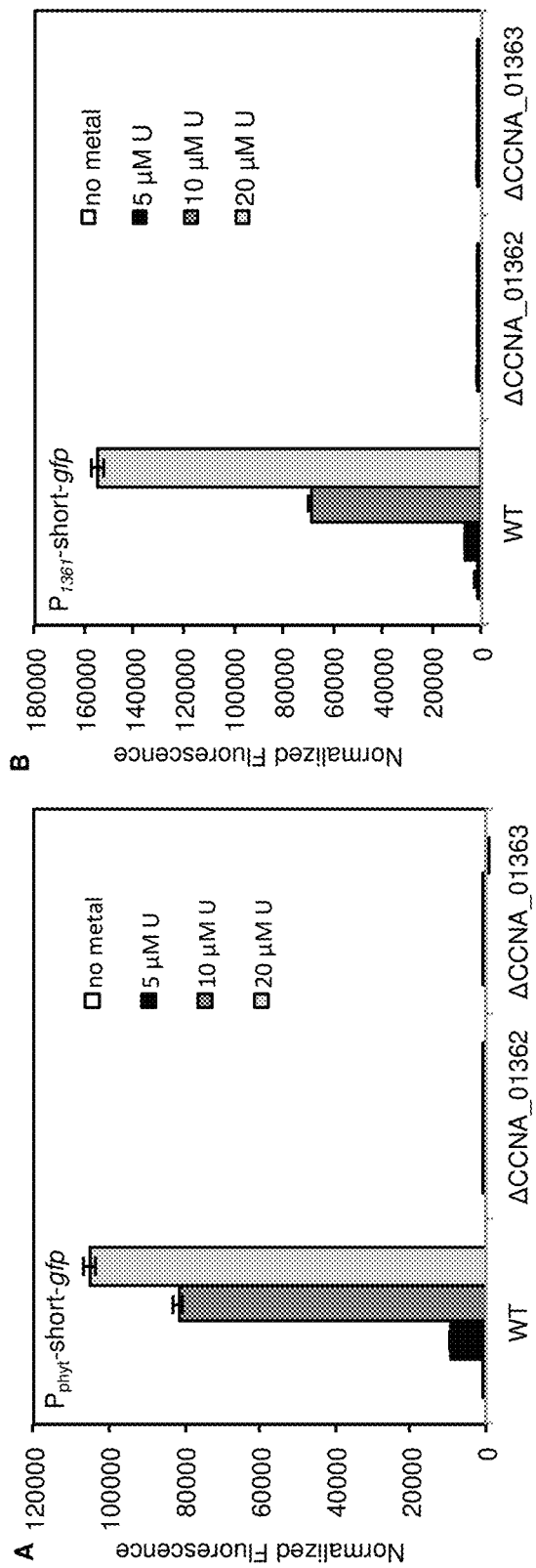
FIG. 17 shows graphs reporting quantification of exemplary fluorescence levels of a shortened $P_{phyt}$-gfp (FIG. 17 Panel A) and shortened $P_{1361}$-gfp (FIG. 17 Panel B) variants in response to U at 5 µM, 10 µM or 20 µM.
Figure 18:
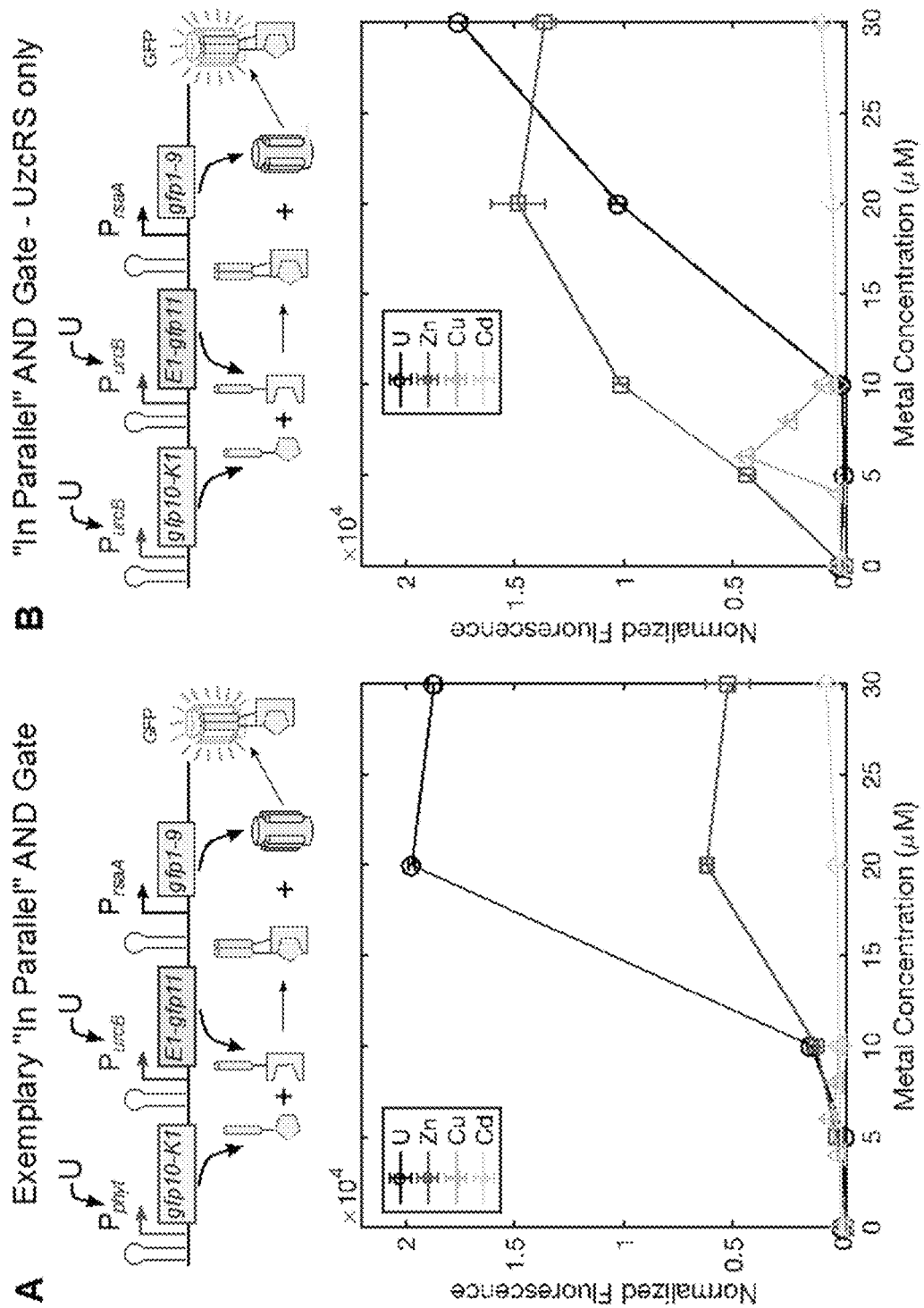
FIG. 18 shows schematics illustrating exemplary tripartite GFP U-sensitive genetic circuits together with graphs reporting quantification of exemplary GFP reporter fluorescence produced by the respective genetic circuits under the conditions indicated. In particular, FIG. 18 Panel A shows a schematic of the U-sensitive genetic circuit shown in FIG. 6 Panel B and FIG. 18 Panel B shows a schematic of a control circuit that incorporates input from only the UzcRS TCS, comprised in the host organism *C. crescentus* NA1000, upon exposure to U, Zn, Cu or Cd.
Figure 19:
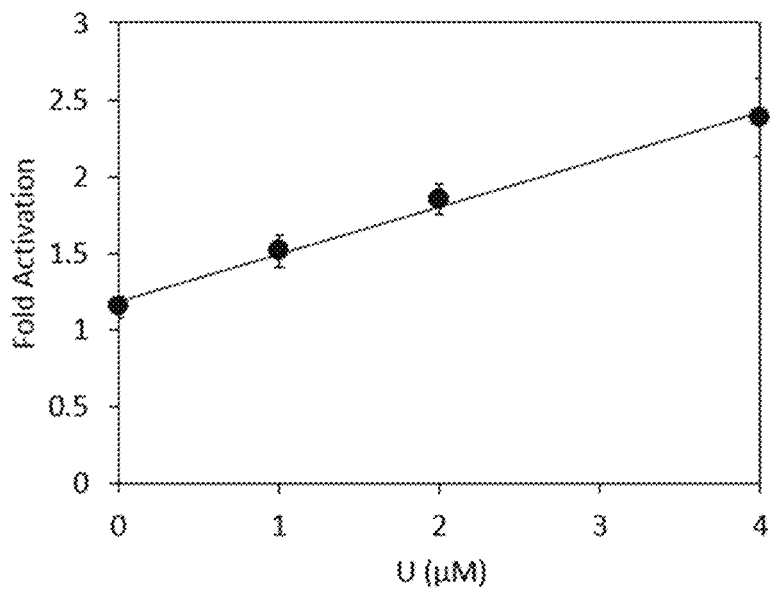
FIG. 19 shows a graph reporting exemplary data indicating the limit of U detection for the U biosensor described in FIG. 4 Panel B. Mid-exponential phase cells were washed twice in 10 mM Pipes pH 7 and then resuspended in 10 mM Pipes pH 7 containing uranyl nitrate. As shown in the graph, a linear response was observed for U concentrations in the low micromolar range.
Figure 20:
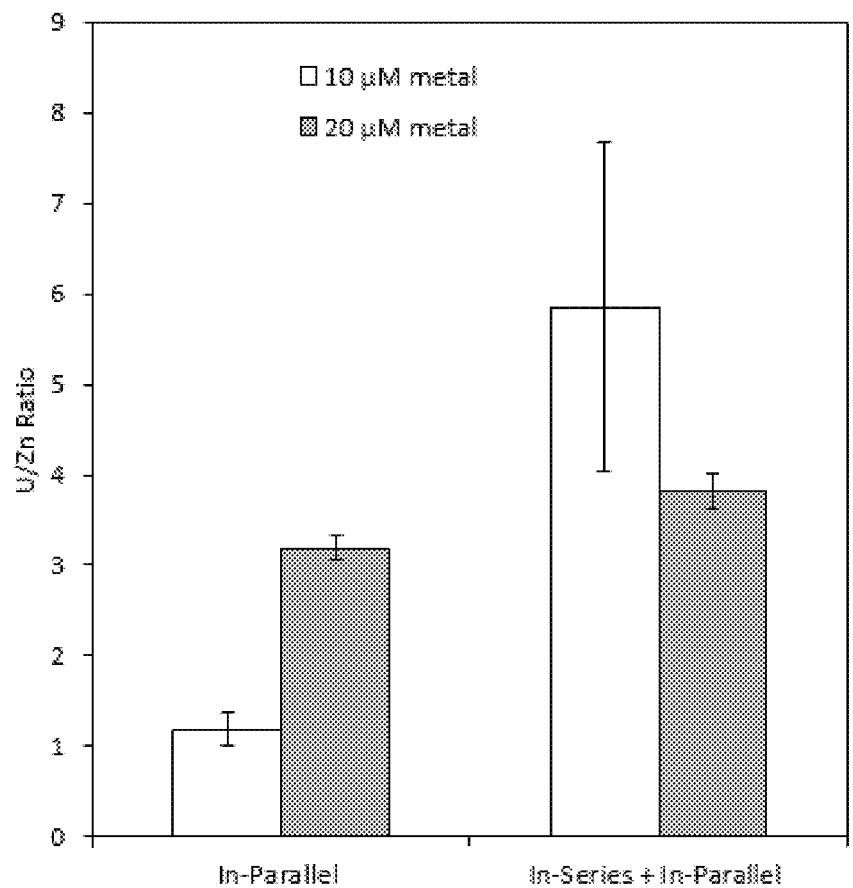
FIG. 20 shows a graph reporting exemplary data showing the ratio of the fluorescence output in response to 10 and 20 µM of U and Zn for the "In-parallel" AND-gate shown in FIG. 6 Panel C and the combined "In-series" plus "in-parallel" genetic circuit shown in FIG. 14. Cells were grown to mid-exponential phase in M5G-G2P media, washed once with fresh media, then resuspended in fresh media containing the indicated metal concentration. Fluorescence was quantified following a three-hour exposure of cells to each metal concentration and normalized to the $OD_{600}$. The U/Zn ratio was calculated by dividing the normalized fluorescence with U by that with Zn.

This direct repeat binding site bears striking resemblance to the binding sites of OmpR/PhoB family response reguformed with both mutants during U exposure. [160] In contrast, deletion of CCNA_01362 or the histidine kinase CCNA_01363 abolished U-dependent induction of both promoters (FIG. 17A-B).

Figure 28:
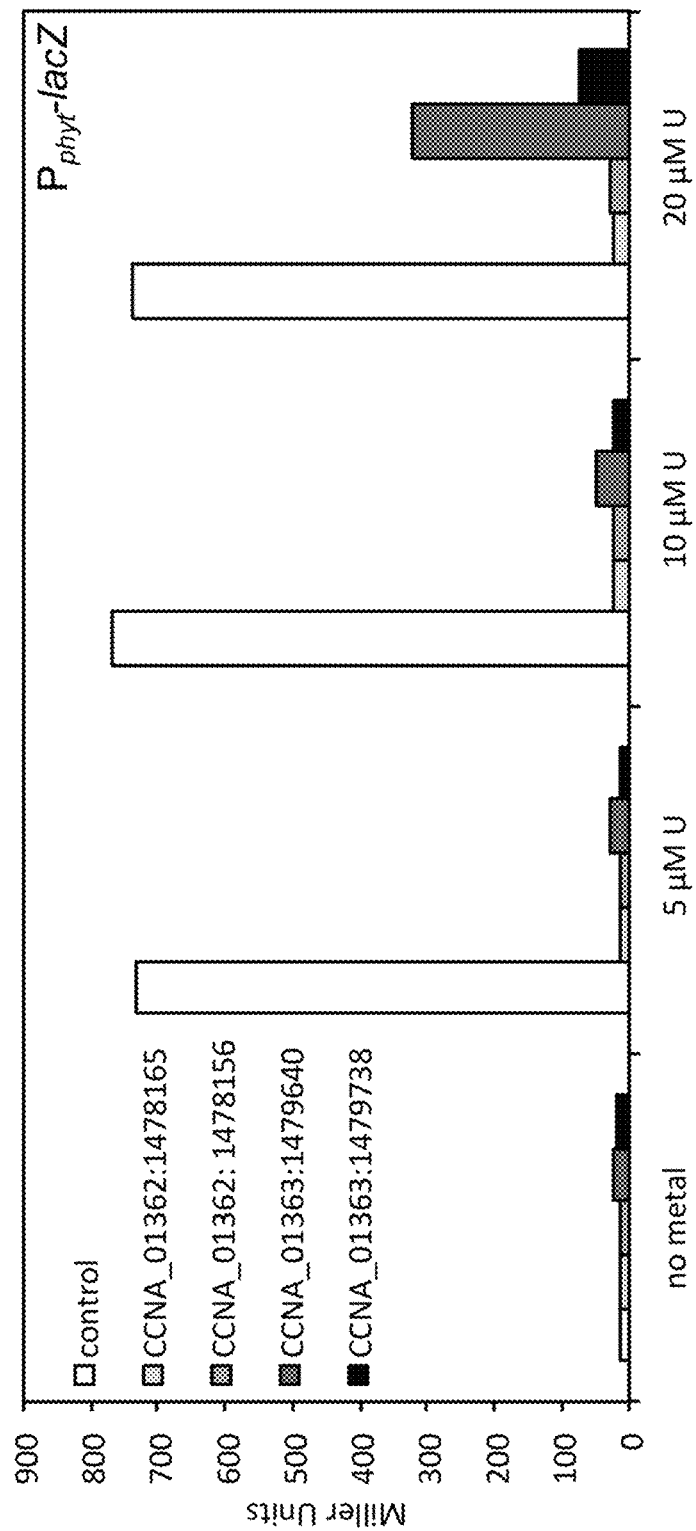
FIG. 28 shows diagrams illustrating the results of experiments showing that transposon insertions within CCNA_01362 and CCNA_01363 abrogate U-dependent induction of $P_{phyt}$. $P_{phyt}$-lacZ activity was assayed in strains containing transposons inserted within CCNA_01362 and CCNA_01363 using β-galactosidase assays. Error bars represent the standard deviation of triplicate measurements.

Furthermore, a forward genetic screen for mutants that failed to induce $P_{phyt}$-lacZ in response to U resulted in five transposons that mapped to unique locations within CCNA_01362 and CCNA_01363 (FIG. 28; Table 9), providing independent validation for a functional role of both proteins in U-dependent stimulation of $P_{phyt}$.

TABLE 9

Transposons in CCNA_01362 and CCNA_01363 that abolished U-dependent induction of $P_{phyt}$-lacZ

| Gene location | Chromosomal location | Number isolated |
|---|---|---|
| CCNA_01362 | 1478156 | 1 |
| CCNA_01362 | 1478165 | 4 |
| CCNA_01363 | 1479640 | 3 |

TABLE 9-continued

Transposons in CCNA_01362 and CCNA_01363 that abolished U-dependent induction of $P_{phyt}$-lacZ

| Gene location | Chromosomal location | Number isolated |
|---|---|---|
| CCNA_01363 | 1479645 | 3 |
| CCNA_01363 | 1479738 | 1 |

These proteins have been putatively named UrpR and UrpS (Uranium Responsive Phytase Regulator and Sensor, respectively), since this TCS strongly activates a gene encoding a phytase enzyme.

Figure 10:
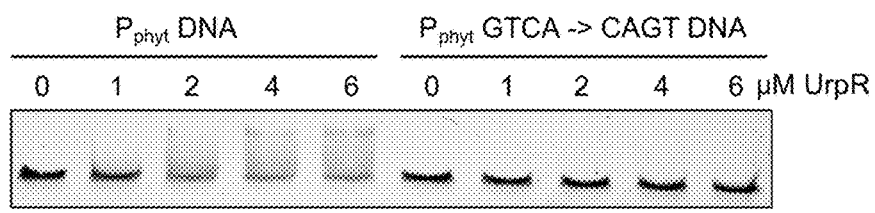
FIG. 10 illustrates the results of an electrophoretic mobility assay (EMSA) showing UrpR binding to wild type and mutant $P_{phyt}$ fragments. The mutant $P_{phyt}$ DNA ($P_{1361}$) contains a GTCA→CAGT mutation of DR2 (see FIG. 7B). The assays were performed with 50 nM 6-FAM-labeled DNA and UrpR, phosphorylated with carbamoyl phosphate. The concentrations indicate the total UrpR used in the assay. A representative example of three biological replicates is depicted.

To confirm that regulation by UrpR is direct, UrpR was purified, and its binding to $P_{phyt}$ was tested using an electrophoretic mobility shift assay. As expected, UrpR bound to $P_{phyt}$ in a concentration-dependent manner (FIG. 10). Binding was not observed to a $P_{phyt}$ fragment containing a 5'-GTCA-3' to 5'-CAGT-3' mutation at DR2 (FIG. 10), supporting the functional role of the direct repeat site in UrpR DNA binding. Collectively, these data suggest that the TCS comprised of UrpR and UrpS is the U-dependent activator of $P_{phyt}$ and $P_{1361}$, revealing a positive feedback loop within this regulatory system.

Example 14: UrpRS Exhibits Improved Metal Selectivity Compared to UzcRS

To test whether UrpRS functions independently of UzcRS with respect to U perception (a property that is important for its dual integration with UzcR in a synthetic U sensing pathway), the expression of $P_{phyt}$ and the UzcR-regulated promoter $P_{urcB}$ were tested in strains lacking the non-cognate TCS. The U-induction profile of a shortened $P_{phyt}$ reporter ($P_{phyt-short}$; diagrammed in FIG. 7A-B) was largely unaffected by deletion of uzcR or uzcS (FIG. 29A; FIG. 30), while the U-induction profile for $P_{urcB}$-gfp was unaffected by deletion of urpR or urpS (FIG. 29A; FIG. 30). Collectively, these data indicate that C. crescentus possesses at least two independent U-responsive TCS.

Figure 29:
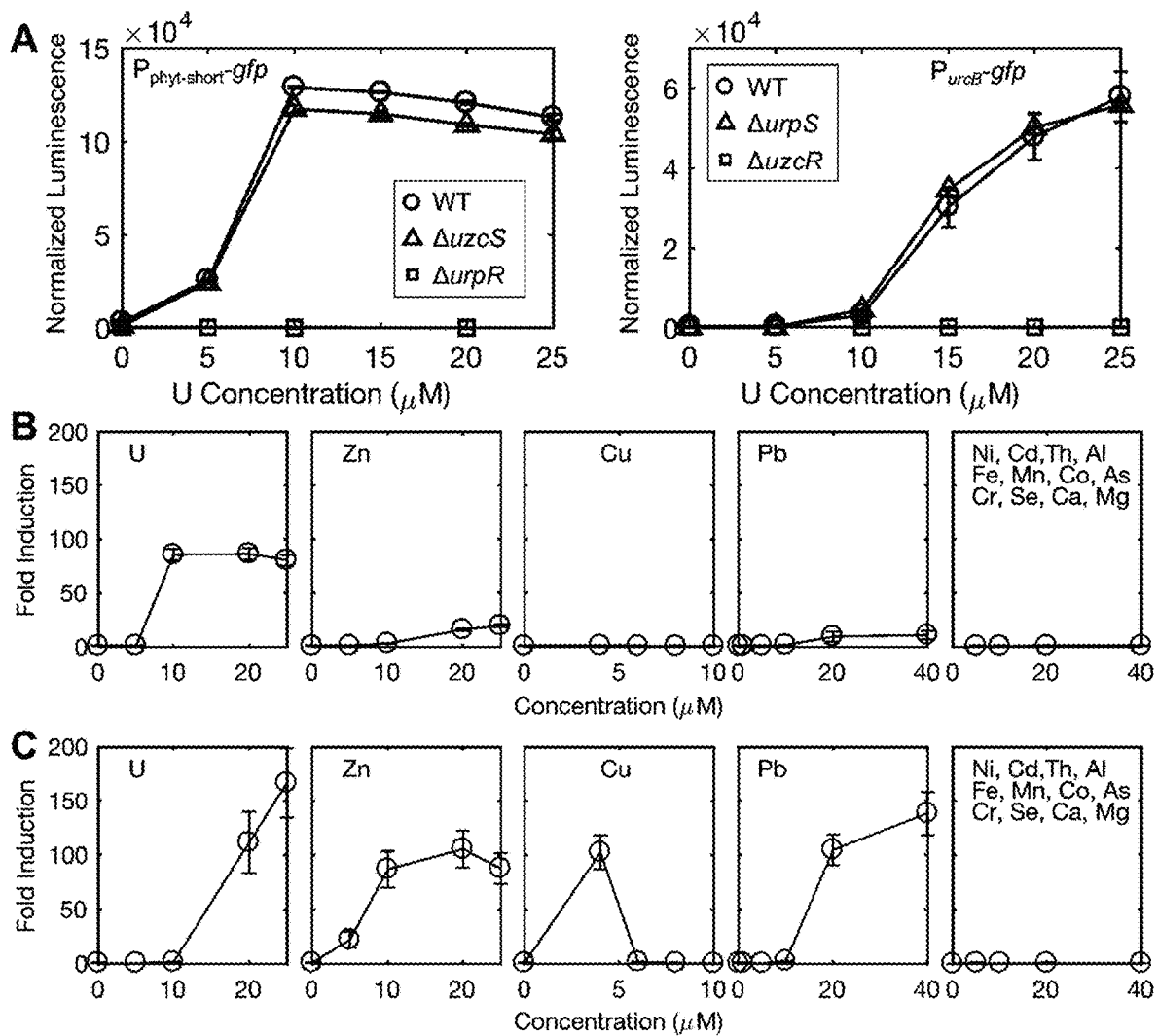
FIG. 29 shows diagrams illustrating the results of experiments showing metal selectivity of UrpRS and UzcRS in an exemplary embodiment. Panel A) Functional independence of UrpRS and UzcRS. U response curves of $P_{phyt\text{-}short}$-gfp and $P_{urcB}$-gfp reporters were determined by quantifying fluorescence following a two-hour exposure to a range of U concentrations in wild type C. crescentus and strains deleted for uzcS, urpS and the cognate response regulator. Error bars represent the average of biological triplicates. Metal selectivity profiles for $P_{phyt\text{-}short}$-gfp (panel B) and $P_{urcB}$-gfp (panel C). Reporter fluorescence was quantified following exposure to 16 metals. The furthest right plot depicts representative data for metals that failed to induce either promoter. Raw fluorescence values can be found in Table 10. Error bars represent the average of biological triplicates.
Figure 30:
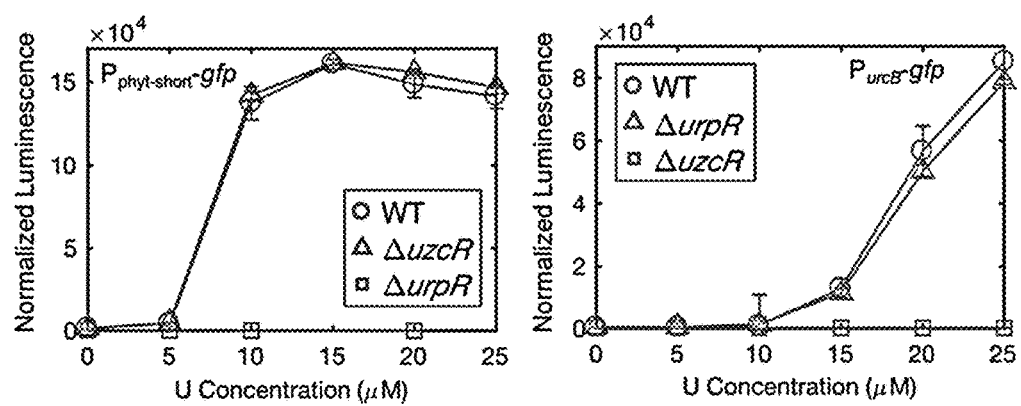
FIG. 30 shows diagrams illustrating the results of experiments showing in an exemplary embodiment functional independence of UrpRS and UzcRS. Fluorescence of a $P_{phyt\text{-}short}$-gfp and $P_{urcB}$-gfp were quantified following a two-hour exposure to a range of U concentrations in wild type C. crescentus and strains deleted for uzcR and urpR. Error bars represent the average of biological triplicates.

To determine the metal selectivity of UrpRS, $P_{phyt-short}$-gfp fluorescence was quantified following exposure to 16 metals of environmental relevance (FIG. 29B). To encourage metal solubility and thus bioavailability, minimal media containing glycerol-2-phosphate ($G_2P$) was employed as the sole source of phosphate. As a control, the metal selectivity of the $P_{urcB}$-gfp reporter was also tested (FIG. 29C). For both promoters, the strongest induction was observed in response to U; however, $P_{phyt-short}$ exhibited greater U sensitivity, resembling a switch-like activation response (FIG. 29A) that can likely be attributed to the strong positive auto-regulation within the UrpRS system. Most metals, including Th, a radionuclide that is part of the U decay chain and likely co-occurs with U, failed to induce either reporter (Table 10).

TABLE 10

Metal selectivity of UrpRS and UzcRS

| Metal | $P_{phyt}$-gfp Fold Induction | $P_{phyt}$-gfp std dev | $P_{urcB}$-gfp Fold Induction | $P_{urcB}$-gfp std dev |
|---|---|---|---|---|
| 5 µM U | 1.3 | 0.2 | 0.8 | 0.1 |
| 10 µM U | 85.7 | 5.1 | 1.7 | 0.3 |
| 20 µM U | 86.4 | 5.3 | 111.5 | 28.3 |
| 25 µM U | 80.5 | 5.0 | 166.7 | 32.0 |

TABLE 10-continued

Metal selectivity of UrpRS and UzcRS

| Metal | $P_{phyt}$-gfp Fold Induction | $P_{phyt}$-gfp std dev | $P_{urcB}$-gfp Fold Induction | $P_{urcB}$-gfp std dev |
|---|---|---|---|---|
| 5 µM Zn | 1.2 | 0.1 | 22.2 | 7.4 |
| 10 µM Zn | 3.2 | 0.3 | 87.0 | 16.7 |
| 20 µM Zn | 16.1 | 1.0 | 105.5 | 17.0 |
| 25 µM Zn | 19.7 | 1.3 | 87.6 | 14.0 |
| 4 µM Cu | 1.3 | 0.1 | 102.5 | 15.5 |
| 6 µM Cu | 0.9 | 0.2 | 1.8 | 0.5 |
| 8 µM Cu | 0.8 | 0.1 | 0.9 | 0.2 |
| 10 µM Cu | 0.8 | 0.1 | 0.4 | 0.3 |
| 20 µM Ni | 1.1 | 0.1 | 0.9 | 0.1 |
| 40 µM Ni | 1.3 | 0.1 | 0.7 | 0.3 |
| 20 µM Cd | 1.0 | 0.1 | 1.6 | 0.6 |
| 40 µM Cd | 0.9 | 0.1 | 1.9 | 0.4 |
| 5 µM Th(IV) | 1.0 | 0.1 | 0.8 | 0.1 |
| 10 µM Th(IV) | 1.0 | 0.1 | 1.1 | 0.3 |
| 20 µM Th(IV) | 1.0 | 0.1 | 0.8 | 0.1 |
| 40 µM Th(IV) | 1.0 | 0.1 | 1.0 | 0.2 |
| 1 µM Pb | 1.0 | 0.1 | 1.0 | 0.2 |
| 5 µM Pb | 1.1 | 0.1 | 0.6 | 0.3 |
| 10 µM Pb | 1.8 | 0.5 | 2.7 | 0.4 |
| 20 µM Pb | 9.6 | 4.7 | 104.7 | 14.2 |
| 40 µM Pb | 11.1 | 4.1 | 138.5 | 20.1 |
| 20 µM Al | 2.4 | 0.3 | 1.0 | 0.3 |
| 40 µM Al | 2.5 | 0.4 | 1.0 | 0.1 |
| 20 µM Fe(III) | 1.0 | 0.1 | 1.1 | 0.1 |
| 40 µM Fe(III) | 1.1 | 0.1 | 1.1 | 0.1 |
| 20 µM Fe(II) | 1.0 | 0.1 | 0.9 | 0.4 |
| 40 µM Fe(II) | 1.1 | 0.1 | 0.7 | 0.1 |
| 20 µM Mn | 1.0 | 0.1 | 1.1 | 0.4 |
| 40 µM Mn | 1.0 | 0.1 | 1.0 | 0.1 |
| 20 µM Co | 0.7 | 0.1 | 0.4 | 0.1 |
| 40 µM Co | 0.7 | 0.1 | 0.2 | 0.1 |
| 20 µM As | 1.0 | 0.1 | 1.0 | 0.2 |
| 40 µM As | 1.1 | 0.1 | 0.9 | 0.2 |
| 100 µM As | 1.0 | 0.1 | 1.2 | 0.3 |
| 20 µM Cr(VI) | 1.5 | 0.1 | 3.2 | 0.7 |
| 40 µM Cr(VI) | 1.5 | 0.1 | 2.6 | 0.6 |
| 20 µM Se | 0.9 | 0.1 | 0.9 | 0.1 |
| 40 µM Se | 0.9 | 0.1 | 0.8 | 0.1 |

Importantly, $P_{phyt-short}$ was unresponsive to Cu and only minimally responsive to Zn or Pb (FIG. 29B). In contrast, strong $P_{urcB}$ induction was observed with Zn, Pb, and within a narrow Cu range. The Pb-dependent induction of $P_{urcB}$ was surprising and contrasts with prior reports. [153, 163] It is suspected that the Pb induction likely reflects the higher initial Pb bioavailability in the presence of $G_2P$ compared to orthophosphate, given the low solubility of lead phosphate. [171] These data suggest that while UrpRS is not exclusively selective for U, it exhibits an improved metal selectivity profile compared to UzcRS.

Example 15: Construction of a U-Responsive AND Gate Pathway in C. crescentus Given the distinct metal selectivity profiles and functional independence of UzcRS and UrpRS, it is expected that a combinatorial approach that incorporates the U-responsive functionality of both UrpRS and UzcRS will yield a whole-cell U sensor with enhanced specificity. Accordingly, the recently developed Tripartite GFP system [164] was used as a template to construct a U sensing AND gate. In this system, GFP is split into three parts (gfp10, gfp111 and gfp1-9) that interact to reconstitute active GFP when co-expressed; the synthetic $K_1$ and E1 coiled-coils[172] were fused to the C-terminus of gfp10 and the N-terminus of gfp11, respectively, to mediate dimerization. [164] An advantage of the tripartite system is the low basal level of GFP fluorescence, ensuring a robust OFF state.

Figure 31:
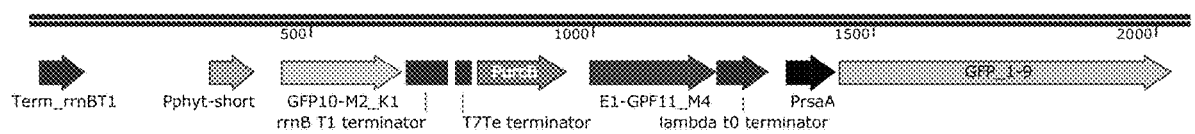
FIG. 31 illustrates a schematic of U-sensing AND gate configuration that was integrated at the chromosomal urcA locus. Details of AND gate construction and chromosomal integration are outlined in the methods sections.
Figure 32:
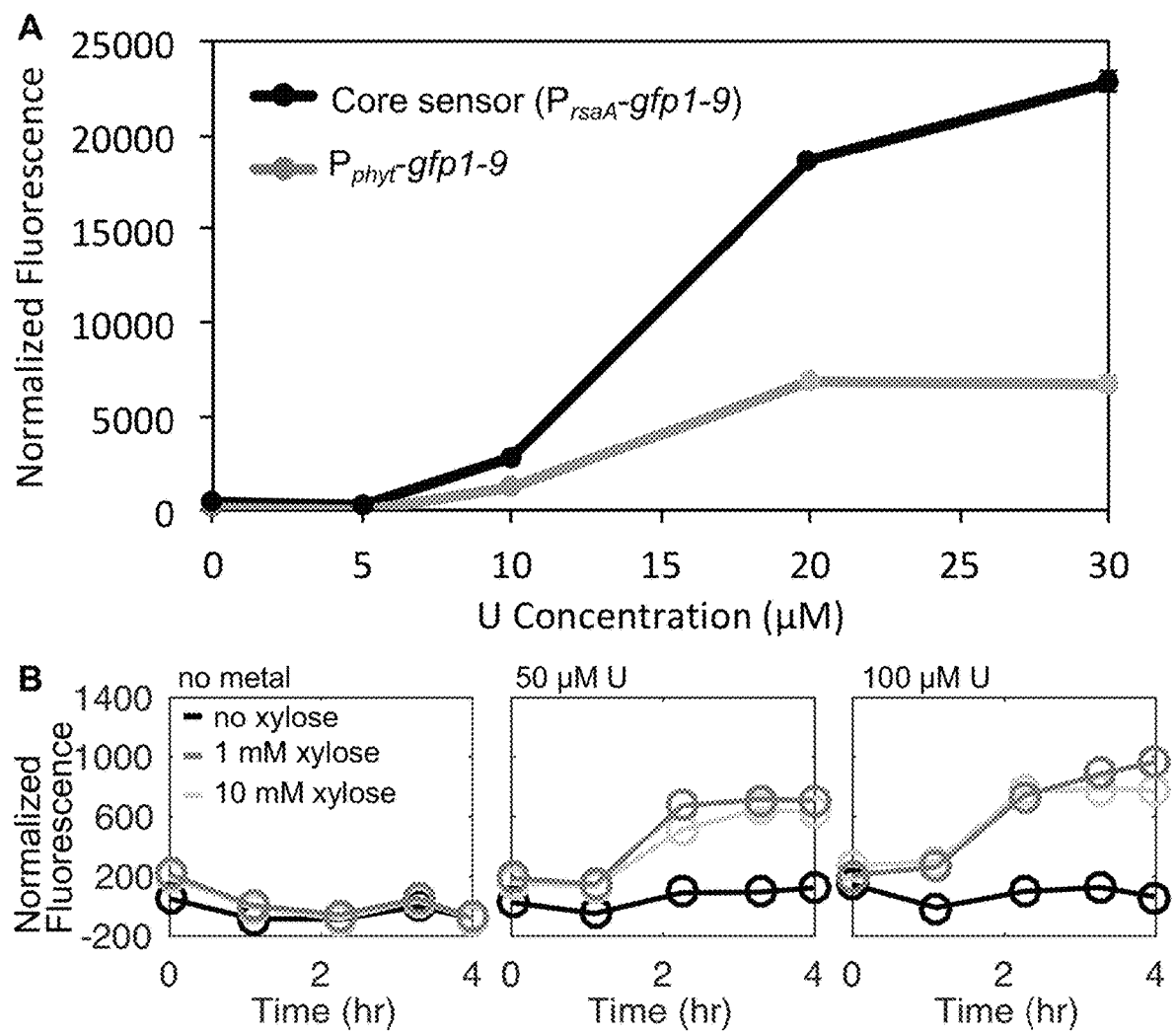
FIG. 32 shows diagrams illustrating the results of experiments showing in an exemplary embodiment U sensing AND gate variants with different mechanisms of gfp1-9 expression. Panel A shows the fluorescence output profile of the core sensor and a sensor variant with gfp1-9 expression driven by $P_{phyt}$ following a three-hour exposure to the indicated U concentration. Panel B shows the fluorescence output of a U-sensor variant with gfp1-9 expression driven by the xylose-inducible promoter $P_{xyl}$ as a function of time.

$P_{phyt-short}$ and $P_{urcB}$, which both exhibit low basal activity and a large U-dependent fold change, were used to drive expression of gfp10-K1 and E1-gfp11, respectively. The expression of gfp1-9 was driven by the strong, constitutive rsaA promoter ($P_{rsaA}$) [4] in order to produce high GFP1-9 levels at all stages of growth (FIG. 14A; diagrammed in FIG. 31). Hereafter, this sensor configuration in an otherwise wild type (WT) strain background is referred to as the core sensor. Sensor variants where gfp1-9 expression was driven by the xylose-inducible promoter ($P_{xyl}$) [6] or the UrpR-regulated $P_{phyt}$ were also tested, but exhibited a lower signal amplitude and were not pursued further (FIG. 32). Additionally, attempts to employ the hrp (hypersensitive response and pathogenicity) amplifier from Pseudomonas syringae as the AND gate template for U sensor construction by placing hrpR and hrpS under the control of $P_{phyt-short}$ and $P_{urcB}$, respectively, and using $P_{hrpL}$ to drive gfp expression, did not result in a functional sensor.

Figure 33:
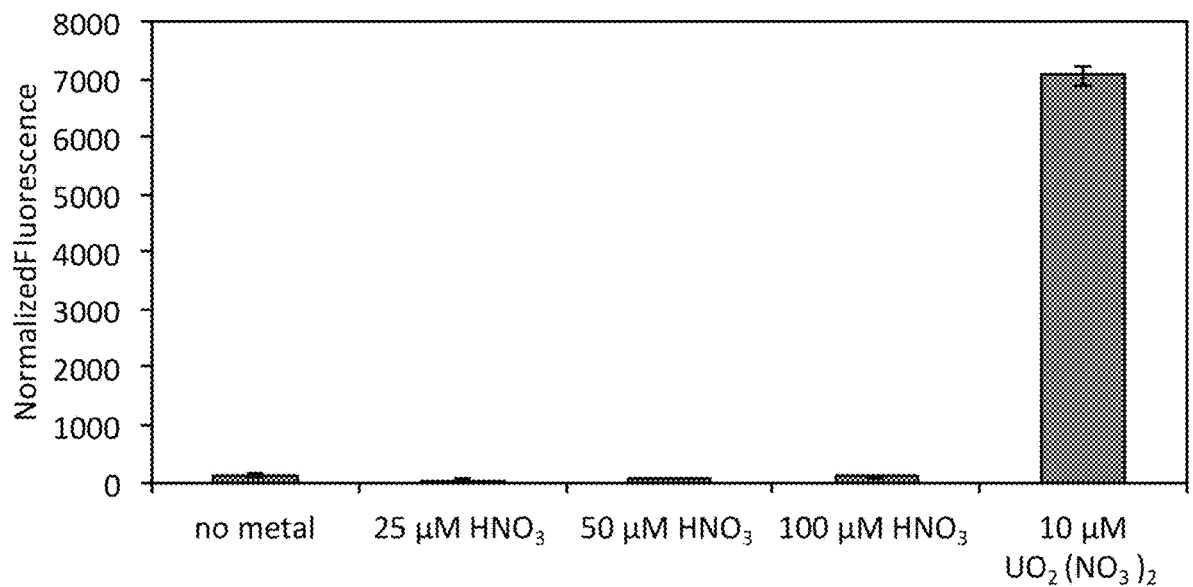
FIG. 33 shows a graph reporting that core sensor is not responsive to nitrate. Given the use of a uranyl nitrate stock in $HNO_3$ (100 mM $UO_2NO_3$ in 100 mM $HNO_3$) to characterize the U sensing performance of the core sensor, control experiments were conducted with $HNO_3$ nitrate alone. Relevant concentrations of $HNO_3$ failed to induce fluorescence, confirming that nitrate alone is not responsible for the core sensor output signal.

Initial characterization of the tripartite U sensor was performed in M5G G$_2$P, given the robust U-dependent induction of both $P_{phyt}$ and $P_{urcB}$ under these conditions and the lack of induction in growth media containing orthophosphate, where U bioavailability is low as a result of uranyl phosphate mineralization. [161, 173] Notably, the basal fluorescence output of the sensor was indistinguishable from a control strain lacking GFP1-9 expression, supporting a very low OFF state (FIG. 14B). Addition of uranyl nitrate, but not nitrate alone (FIG. 33), yielded a nonlinear fluorescence response curve that deviated from background at concentrations as low as 5 µM and plateaued at ~15 µM (FIG. 14B). The hypersensitivity of the U response curve was quantified by fitting the data with a Hill function. It is noted that this approach is semiempirical, and it is not used as a basis to derive insight on the mechanisms of the reactions occurring in the system. The model revealed a hill coefficient hypersensitive nature of the U response curve suggests that the core sensor is well poised as a qualitative YES/NO digital sensor of environmental U.

Importantly, U-dependent fluorescence was not observed with control sensor variants that lacked either a functional UrpR binding site in $P_{phyt-short}$ or gfp1-9 expression (FIG. 14B). Additionally, deletion of uzcR severely impaired, but did not completely abolish, U-dependent fluorescence (FIG. 14B). Since the data in FIG. 29A indicate that $P_{urcB}$ activity is abolished by uzcR deletion, the minor induction of sensor fluorescence in the ΔuzcR strain may reflect low-level transcriptional read-through of the transcription terminator separating $P_{phyt-short}$-gfp0-K$_1$ and $P_{urcB}$-E1-gfp11 modules (diagramed in FIG. 31). Collectively, these data highlight the requirement for expression from all three promoters for a U-dependent fluorescent output.

Figure 34:
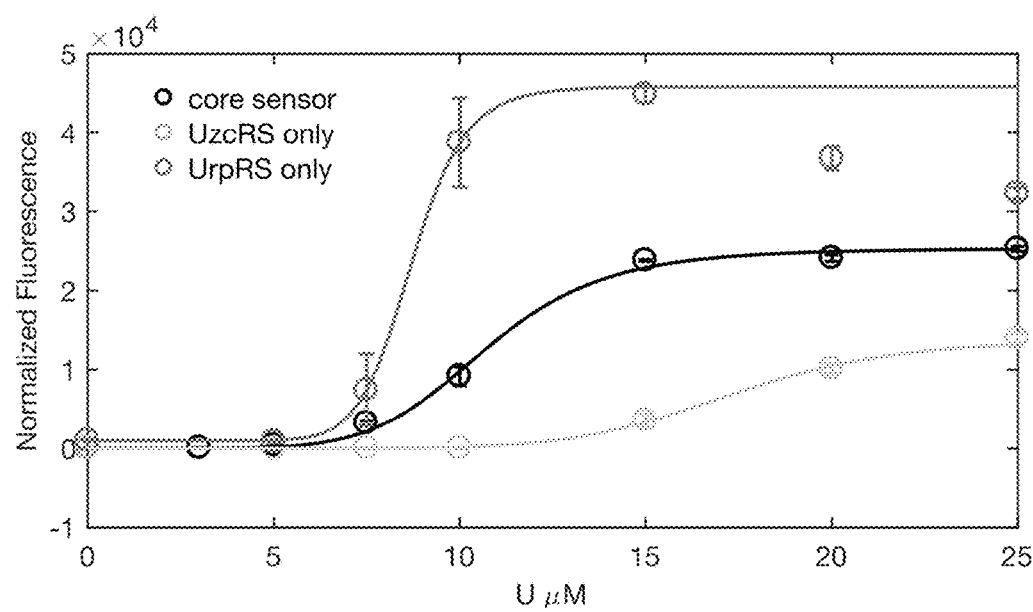
FIG. 34 shows in a graph the U response curves for the core sensor and control variants in which the expression of gfp10-K1 and E1-gfp11 components is driven by UzcRS or UrpRS alone. Fluorescence was quantified following a three-hour exposure to a range of U concentrations. The data were fit with a Hill equation to determine the U concentration that yields half-maximal fluorescence induction and the hill slope as an indicator of U sensitivity. Data points with diminished fluorescence output were not included in the curve fitting.
Figure 40:
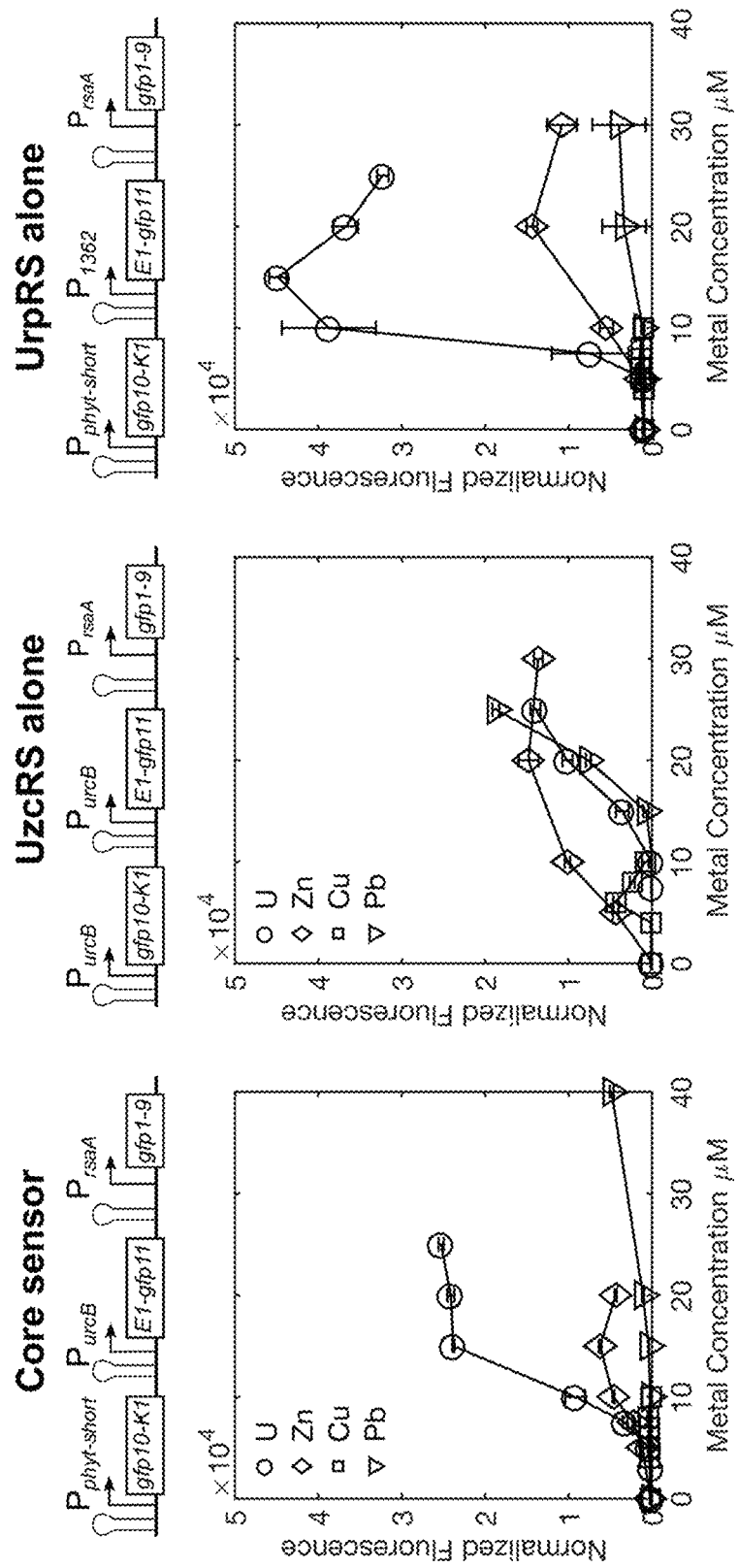
FIG. 40 shows a metal selectivity profile of core sensor and control variants. The top panel depicts simplified schematics of the core sensor and control variants in which the expression of gfp10-K1 and E1-gfp11 components is driven by UzcRS or UrpRS alone. The bottom panel depicts the U/Zn/Cu/Pb response curves for the core sensor and control variants. Fluorescence was quantified following a three-hour exposure to a range of metal concentrations. Error bars represent the average of biological triplicates.

Example 16: U-Sensing AND Gate Exhibits Improved Selectivity Relative to UzcRS Alone To characterize the selectivity of the core sensor, fluorescence was quantified in response to known inducers of either TCS and compared to results obtained with control sensor variants where either UzcRS or UrpRS governs the expression of both gfp10 and gfp11 (FIG. 40). Consistent with the U response curves for $P_{phyt-short}$- and $P_{urcB}$-gfp fusions (FIG. 29A), the control sensor driven by UrpRS alone yielded a U response curve with greater sensitivity compared to the sensor driven by UzcRS alone ($n^H$ of 12.5, K of 8.8 µM compared to $n^H$ of 7.9 and K of 17.4 µM; Table 11; FIG. 34).

TABLE 11

| | Hill function fitting | | |
|---|---|---|---|
| Sensor Variant | Half maximal fluorescence (K) | Hill coefficient | $R^2$ |
| core sensor | 9.9 (0.1) | 7.6 (0.3) | 0.996 |
| constitutive UzcY | 6.3 (0.0) | 11.0 (0.6) | 1 |
| $P_{phyt}$-uzcY | 8.4 (0.1) | 9.5 (0.2) | 1 |
| UzcRS only | 17.4 (0.6) | 7.9 (0.3) | 0.995 |
| UrpRS only | 8.8 (0.7) | 12.5 (1.1) | 0.999 |

Figure 35:
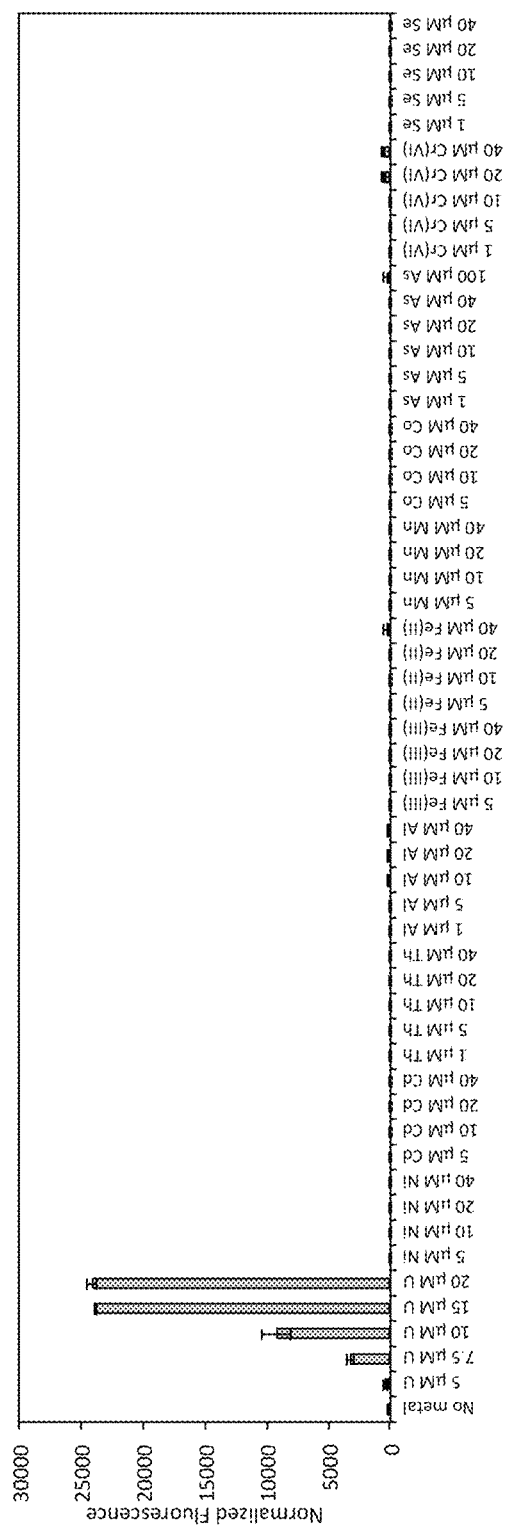
FIG. 35 shows diagrams illustrating the results of experiments showing metal selectivity profile of a core sensor. Fluorescence was quantified following a two-hour exposure to each metal. Error bars represent the average of biological triplicates.
Figure 37:
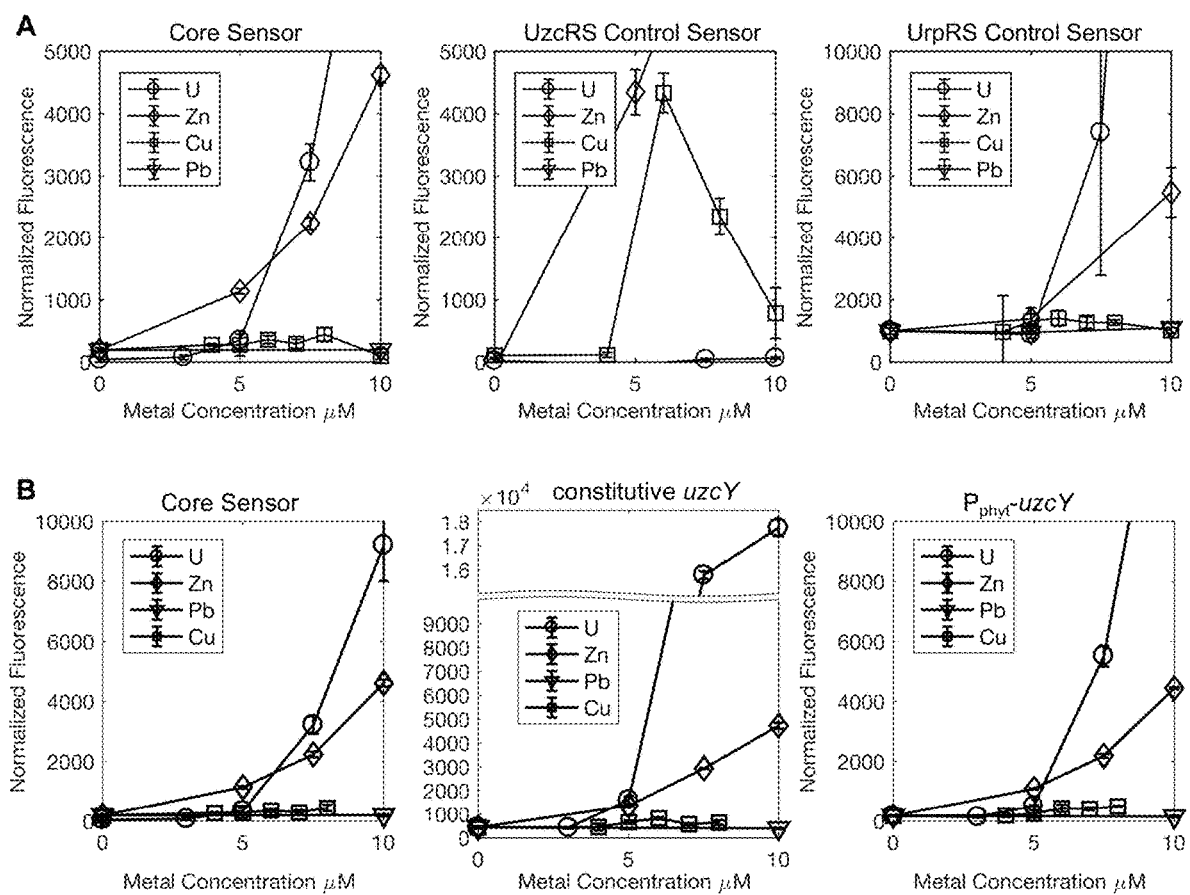
FIG. 37 shows a zoomed in version of the U/Zn/Cu/Pb response curves for the core sensor, control variants, and uzcY amplifier variants. In particular, FIG. 37 Panel A shows the curves for the Core Sensor, UzcRS Control Sensor and UrpRS control Sensor.

As expected, the core sensor was unresponsive to Ni, Cd, Th, Al, Fe(III), Fe(II), Mn, Co, arsenate, Se, and chromate (FIG. 35). The core sensor and the sensor variant driven by UrpRS alone were also unresponsive to Cu, in contrast to the sensor driven exclusively by UzcRS (FIG. 40). Critically, the sensitivity of the core sensor to Zn and Pb was significantly diminished relative to the UzcRS control; high Pb concentrations (greater than 20 uM) were required for weak fluorescence induction while the Zn-induced fluorescence was reduced relative to U for every tested concentration. Despite the improved selectivity for U, low Zn concentrations (5 M Zn) yielded a fluorescence response in the core sensor that exceeded the U response (FIG. 37). Nevertheless, the lack of Cu responsiveness and the weakened Zn/Pb responsiveness of the core sensor relative to a sensor constructed with UzcRS alone highlights the selectivity improvement of the AND gate approach.

Example 17: Integration of UzcY Signal Amplifier Improves U Sensitivity and Selectivity A notable limitation of this AND gate approach is that the improved selectivity comes at a cost to U sensitivity in the low micromolar range; incorporation of the less sensitive UzcRS TCS yielded a sensor with lower sensitivity compared to the control sensor driven by UrpRS alone (FIG. 34). Notably, swapping the UzcRS-regulated $P_{urcB}$ promoter with $P_{urcA}$, a promoter that is highly induced by UzcR and sensitive to low UzcR-P concentrations, failed to significantly improve sensor sensitivity (Data not shown). This suggests that simply swapping $P_{urcB}$ with an alternative UzcR-regulated promoter is unlikely to remedy the sensitivity limitation.

As an alternative approach to improve the coupling and matching of the UzcRS and UrpRS inputs, the use of a signal amplifier module was considered to boost the sensitivity of UzcRS. While the hrp (hypersensitive response and pathogenicity) amplifier from Pseudomonas syringae appeared to be a logical choice given its impressive ability to increase the sensitivity and output dynamic range of the ArsR-based arsenic sensor, it was unable to generate a functional U sensor using hrpR, hrpS, and $P_{hrpL}$ components in C. crescentus. Instead, the recently identified membrane protein UzcY that functions as a native signal amplifier for the UzcRS system was leveraged. Under normal growth conditions, uzcY expression is silenced by the MarR family regulator MarR$_1$ (CCNA_03498) and has no effect on UzcRS activity. However, when UzcY expression is induced by deleting marR$_1$, the sensitivity of UzcRS to its metal inducers is enhanced. The signal amplification mechanism was incorporated within the core sensor by either deleting marR$_1$, which yields a constitutive amplifier function, or by swapping the native uzcY promoter with the UrpRS-regulated $P_{phyt-short}$ (FIG. 36A), such that UzcY levels are modulated in a U-concentration dependent manner.

Figure 36:
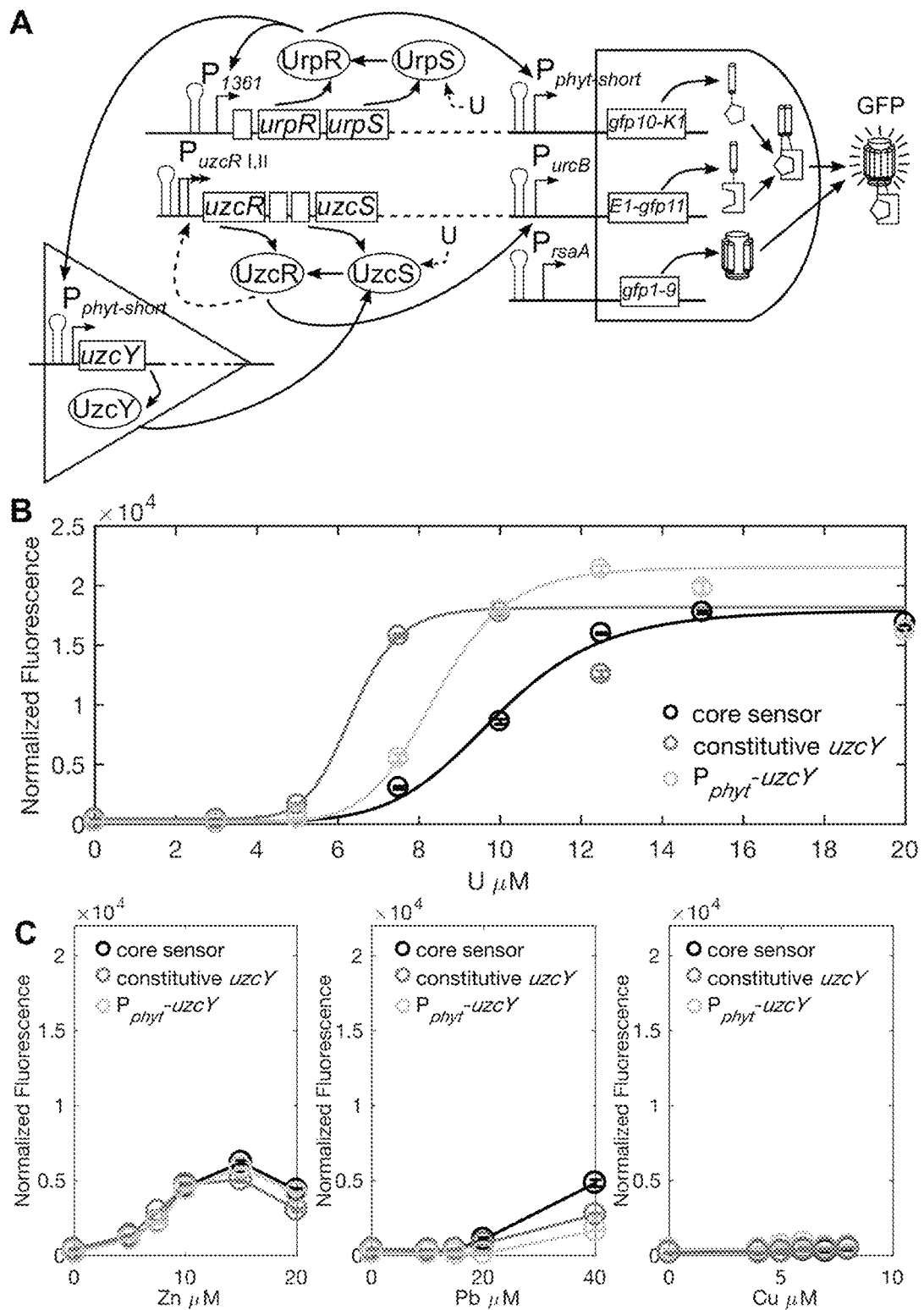
FIG. 36 shows graphs reporting incorporation of a signal amplifier module within the core sensor circuitry. Panel A: schematic for the integration of the UzcY signal amplifier within the U-sensing AND gate. In this variant, uzcY is placed under the control of the U-specific promoter $P_{phyt\text{-}short}$ such that the signal amplification is restricted to conditions of U exposure. Panel B: The fluorescence output of the core sensor and signal amplifier variants following a three-hour exposure to a range of U concentrations. The data were fit with a Hill equation to determine the U concentration that yields half-maximal fluorescence induction and the hill slope as an indicator of U sensitivity. Signal amplifier data points with diminished fluorescence output were not included in the curve fitting. Panel C: The fluorescence output of the core sensor and signal amplifier variants following a three-hour exposure to a range of Zn, Pb, and Cu concentrations. Error bars represent the average of biological triplicates.

Constitutive UzcY expression significantly enhanced the U sensitivity of the core sensor in the low U concentration range (5-10 µM), yielding a U-dependent fluorescence profile with comparable sensitivity ($n^H$ of 11, K of 6.3 µM; FIG. 36B; Table 11) to the sensor driven exclusively by UrpRS alone ($n^H$ of 12.5; K of 8.8 µM). A diminished fluorescence output was observed at U concentrations above 10 µM, and may reflect reduced tolerance of the $\Delta marR_1$ strain to U toxicity compared to WT as was previously observed for Zn. Placing uzcY under the control of $P_{phyt-short}$, and, thus, conditionally restricting UzcY function to conditions of UrpRS stimulation, improved sensitivity ($n^H$ of 9.5, K of 8.4) in the 7.5-12.5 µM range, but not to the same degree as constitutive uzcY expression (FIG. 36B). Importantly, neither amplifier configuration altered the Zn-, Cu-, or Pb-dependent induction profile of the core sensor (FIG. 36C). By enhancing U sensitivity without affecting Zn sensitivity, the expression of UzcY significantly improved the U to Zn output ratio in the low concentration range (5-10 µM; FIG. 37).

Collectively, these data suggest that in M5G $G_2P$, integration of the UzcRS-specific signal amplifier UzcY overcame the sensitivity limitations of the UzcRS TCS, and enhanced the selectivity for U compared to the core sensor. While the sensitivity and selectivity of this amplified sensor are comparable to the sensor driven by UzcRS alone, the use of a combinatorial sensing approach is expected to be beneficial for minimizing core sensor cross-reactivity with yet unidentified inducers of UrpRS. This is based on the expectation that UrpRS is directed to detect a stress that is likely to be encountered in the oligotrophic freshwater environment of this bacterium.

Example 18: Whole-Cell U Sensor Detects as Low as 1.0 uM in Groundwater

To test the efficacy of the sensor to detect U in ground water, samples from three distinct locations were obtained from LLNL site-300, a high-explosives test facility in the Altamont Hills of California where ground water concentrations of U exceed the EPA MCL. Quantification of the heavy metal content of each sample using ICP-MS or ICP-OES revealed U concentrations that range from 1.0 to 1.24 µM (238-295 ppb; Table 12), representing a challenging test for the whole-cell sensor given the ~5 µM detection limit observed in M5G $G_2P$ medium. The trace metals Zn, Pb, Cu, Cd, and Cr were either undetectable or in the low nanomolar range in all samples (Table 12), and thus not expected to affect sensor performance.

TABLE 12

Heavy metal concentrations in ground water samples

| Sample Site | U (µM) | Zn | Pb | Cu | Cd | Cr |
|---|---|---|---|---|---|---|
| Well W-815-2621 | 1.01 (0.02) | <150 nM | 6 nM | 13 nM | <9 nM | <19 nM |
| Well W-812-01 | 1.24 (0.02) | <150 nM | 5 nM | 11 nM | <9 nM | <19 nM |
| Well W-6C | 1.09 (0.00) | <150 nM | <5 nM | 8 nM | <9 nM | <19 nM |

Figure 38:
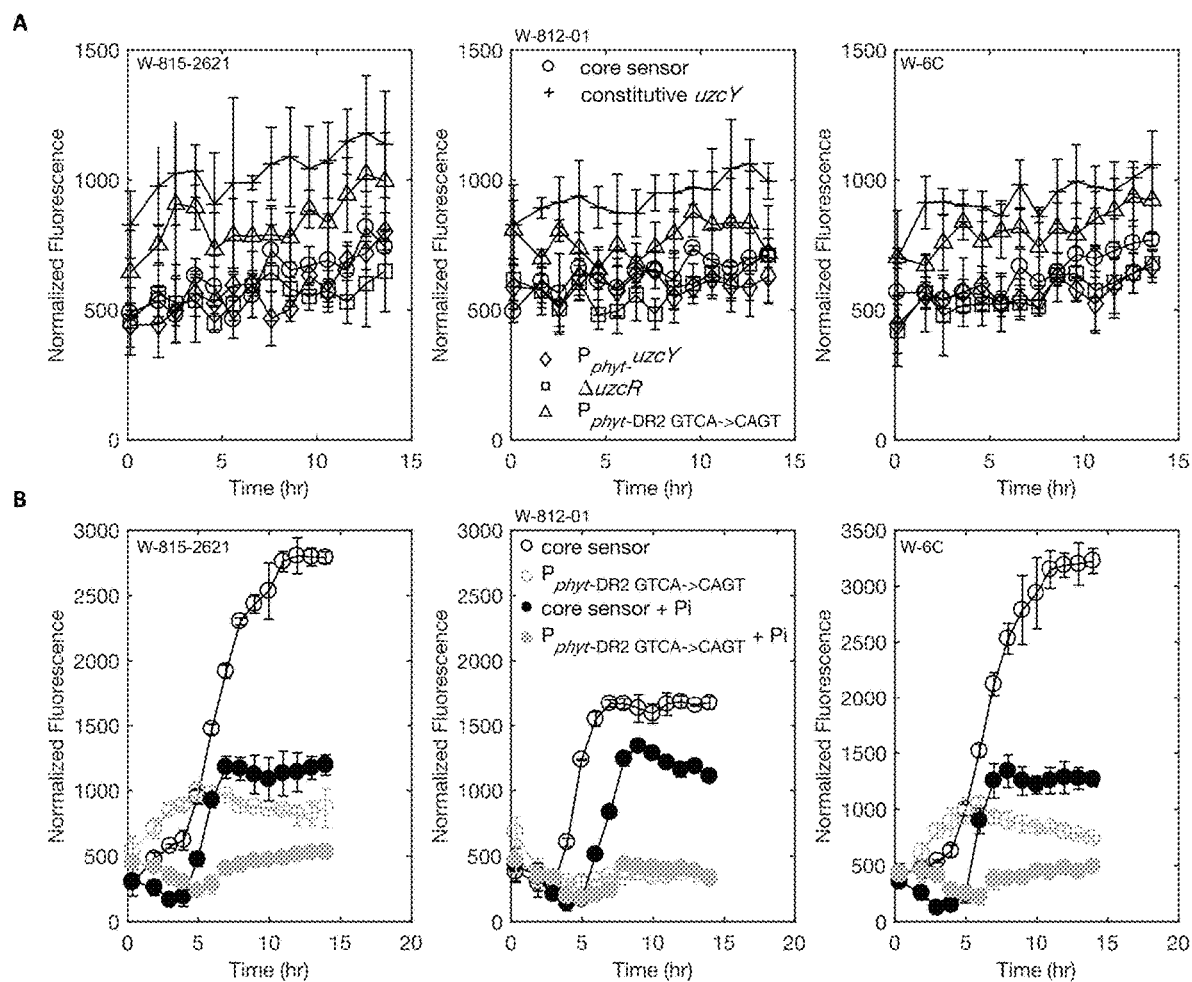
FIG. 38 shows graphs reporting fluorescence output of sensor variants in ground water samples without nutrient supplementation.
Figure 39:
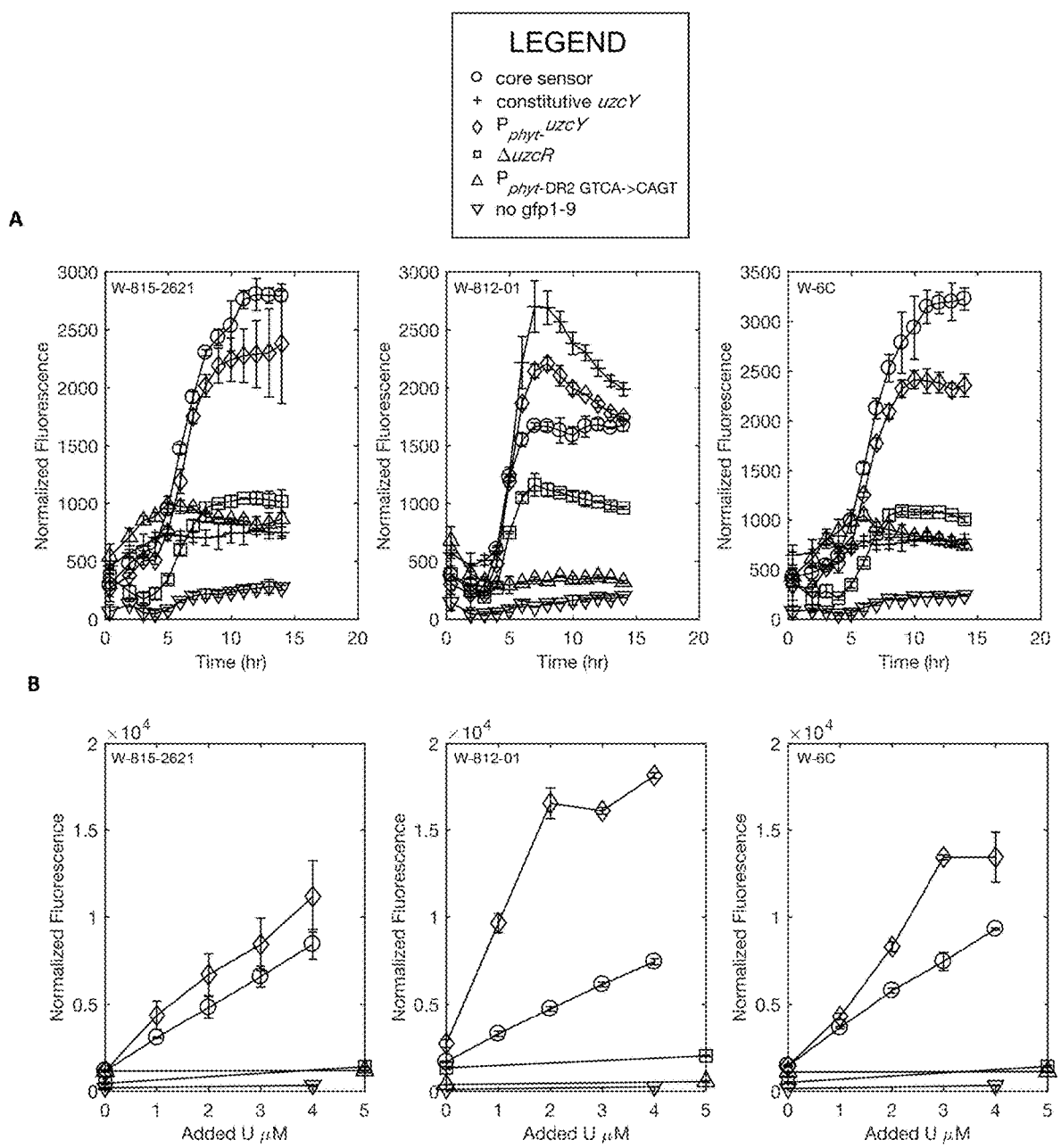
FIG. 39 shows detection of U in ground water samples in an exemplary embodiment.

The fluorescence output of the core sensor, UzcY amplifier variants, and negative controls lacking UzcRS, UrpRS, or gfp1-9 input were monitored as a function of time in the site-300 samples with and without growth nutrient supplementation. Exposure of the sensor strains to unmodified site-300 samples yielded no detectable increase in fluorescence and no cell growth (FIG. 38A; Data not shown). In contrast, supplementation with glucose, glycerol-2-phosphate (P source), and ammonium chloride (N source) together, but not glucose alone (data not shown), enabled cell growth and yielded a detectable increase in fluorescence for the core sensor within six hours of exposure to each sample (FIG. 39A). The fluorescence induction of the core sensor was significantly reduced in all samples when $G_2P$ was replaced with orthophosphate, which reduces U bioavailability (FIG. 38B). For samples 1 and 3 (~1 µM U), the $P_{phyt-short}$-uzcY amplifier variant yielded a fluorescence induction profile with slightly lower amplitude compared to the core sensor, while the constitutive amplifier failed to produce an output that differed from the negative controls (FIG. 39A). Future efforts will seek to optimize the constitutive level of UzcY to improve this sensor variants performance in environmental samples. In contrast, in sample 2 (~1.24 µM U), both signal amplifier variants yielded a fluorescence output signal that exceeded that of the core sensor (FIG. 39A), suggesting that UzcRS is limiting U sensor sensitivity in sample 2. Lastly, compared to the negative controls lacking a UrpR binding site or gfp1-9 expression, the $\Delta uzcR$ mutant yielded a fluorescence induction profile with similar kinetics, but lower signal amplitude compared to the core sensor. This result suggests that while $P_{urcB}$-E1-gfp11 is incompletely insulated from upstream UrpRS-mediated transcriptional activity, the function of both TCS is required to produce the fluorescence response of the core sensor in the ground water samples.

To further confirm U detectability in the ground water samples, uranyl nitrate was added in small, incremental amounts (1 uM increments), and fluorescence was quantified following a six-hour exposure (FIG. 39B). The rational is that if U is responsible for the fluorescence induction of the whole-cell sensors then small, incremental U additions should further boost sensor fluorescence. A nearly identical linear increase in fluorescence as a function of U concentration was observed for the core sensor in all three ground water samples. The $P_{phyt-short}$-UZCY amplifier variant yielded a comparable fluorescence output as the core sensor in sample 1, but enhanced the signal amplitude for all U concentrations in samples 2 and 3, supporting its ability to increase sensitivity in an environmental context. Collectively, these data confirm the functionality of the AND gate sensor to detect U in environmental samples and support a lower limit of detection for U of ~1 µM (~238 ppb). This result is in agreement with the ~0.5 µM detection limit reported for the UzcRS-regulated $P_{urcA}$-gfpUV sensor [163] and comparable with other field-portable U detection methodologies such as gamma spec and X-ray fluorescence. While additional work will be required to achieve a detection limit on par with the EPA MCL (30 ppb), the current sensitivity of the AND gate sensor is well suited as a screening mechanism (e.g., yes/no) for elevated U concentrations in regions with known or suspected anthropogenic activities.

The finding that cell growth and U solubility are required for robust U detection has important implications for further sensor development. The inability of the biosensor to detect insoluble forms of uranyl (e.g., uranyl phosphate minerals) may be exploited as a mechanism to distinguish natural from anthropogenic U since natural U commonly occurs in the form of insoluble minerals, [37] and aqueous phosphate concentrations are typically very low (<10 ppb). [34] To circumvent the U-Pi incompatibility, the organophosphate $G_2P$ was employed that serves the dual function of providing a phosphate source for cell growth while maintaining initial U solubility through complexation. [161, 173] Since the physicochemical form—or speciation of U—is dependent on the geochemical conditions and strongly influences bioavailability, and consequently the detectability by this biosensor, addition of $G_2P$ may be an effective means of conditioning the environmental samples for U detection. Evaluating this hypothesis, and ultimately, the utility of the sensor for environmental monitoring, will require systematic characterization of the solution matrix composition. Nevertheless, given the requirement for nutrient supplementation, it is expected that the path toward a fieldable sensor will entail encapsulation of the whole-cell sensor within an integrated detection device that maintains cells in an active state of growth and automates sampling and solution conditioning (e.g., addition of $G_2P$) for detection. Recent efforts have yielded promising results for integrating cell sensors into field-applicable autonomous devices. [137, 138, 174]

By identifying and integrating two independent, U-responsive TCS within a synthetic AND gate circuit, a selective U-sensing functionality was developed in *C. crescentus*. The results highlight the value of a combinatorial approach for selective detection of compounds for which there are no known evolved regulators. This approach is expected to be generalizable and to drive the development of additional, bio-based modules for environmental toxin detection.

Example 19: Naturally Occurring Fluoride Sensing Riboswitches and Related Consensus Sequence The Rfam database was queried to identify naturally occurring F-sensing riboswitches comprising a crcB motif.

2138 fluoride riboswitch sequences were identified and aligned and conserved nucleotides identified from a gapped alignment as illustrated in FIG. 43, which shows the conserved nucleotides in naturally occurring Fluoride sensing riboswitches.

The sequences of the exemplary fluoride sensing riboswitches from the Rfam database are reported in Appendices I and II incorporated herein by references in their entirety.

Example 20: Establishing a Fluoride-Detection Capability in *C. crescentus*

Environmental detection of UF6—or the more stable hydrolysis product $UO_2F_2$, which is rapidly formed when atmospheric $UF_6$ reacts with water vapor [29] strongly suggests an enrichment program. A bacteria-based $UO_2F_2$-sensor will be developed by integrating and optimizing a fluoride-sensing functionality within the engineered whole-cell U biosensor.

Figure 44:
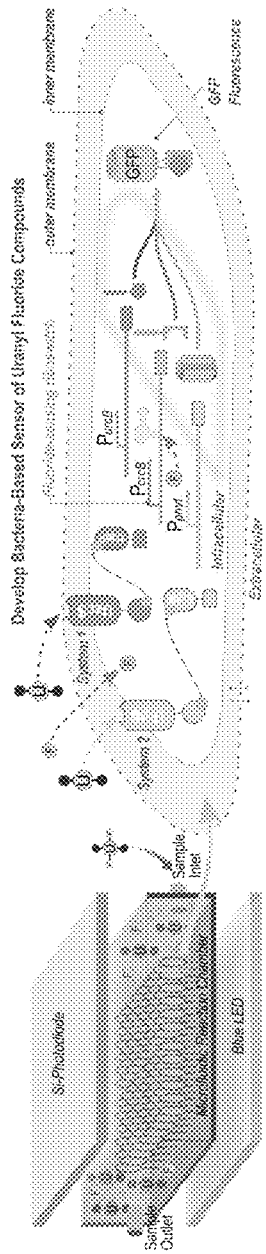
FIG. 44 shows a schematic illustration of a design of a bacteria-based sensor of uranyl fluoride products.

FIG. 44 shows a schematic illustration of an approach which will be used to develop a bacteria-based sensor of uranyl fluoride products. Using a synthetic biology approach, uranium- and fluoride-detection components are expected to be integrated and optimized within *C. crescentus* (right panel) and the $UO_2F_2$ detection performance under aqueous conditions systematically characterized. The left schematic depicts a foreseeable application of the whole cell sensor: autonomous environmental monitoring for aqueous $UO_2F_2$ species by a *C. crescentus* monolayer biofilm.

Example 21: Construction of a crcB-mCherry Fusion and Test Performance in *C. crescentus*

To establish a fluoride detection capability in *C. crescentus*, the fluoride sensing crcB riboswitch [102] will be engineered to control the expression of a fluorescent reporter (e.g., mCherry) such that fluoride perception leads to cell fluorescence. Initial sensor strains will be built with the crcB motifs from three distinct bacteria, including the well-characterized crcB motifs in *P. syringae* DC3000 and *Bacillus subtilis* [102] and an uncharacterized crcB motif from *Sphingomonas* sp. MM-1. *Sphingomonas* sp. MM-1 represents a particularly promising option since this bacterium is closely related to *C. crescentus* and possesses similarly high genomic G+C content (6× %), minimizing compatibility risks with the *C. crescentus* transcriptional machinery. Additionally, despite the lack of biochemical characterization, the function of the *Sphingomonas* sp. crcB motif in fluoride sensing is supported by its homology with characterized crcB riboswitches [Pfam database [109]] and its genomic location upstream of a fluoride exporter.

To accomplish a targeted integration of crcB riboswitches within *C. crescentus*, all crcB-mCherry reporters will be integrated within the *C. crescentus* chromosome. mCherry fluorescence will be quantified in a high-throughput (96-well format) manner over a range of NaF concentrations. Then, the fluoride selectivity will be characterized using commonly encountered anions (e.g., $Cl^-$, $NO_3^-$, $SO_4^{2-}$, $PO_4^{3-}$).

Based on prior biochemical characterization of the *P. syringae* crcB riboswitch [102], we expect the crcB-mCherry reporters to exhibit high fluoride selectivity. Each sensor will be evaluated based on the detection limit, sensitivity, selectivity, dynamic range, and signal amplitude with the best performing crcB-mCherry reporter used for subsequent studies.

Figure 45:
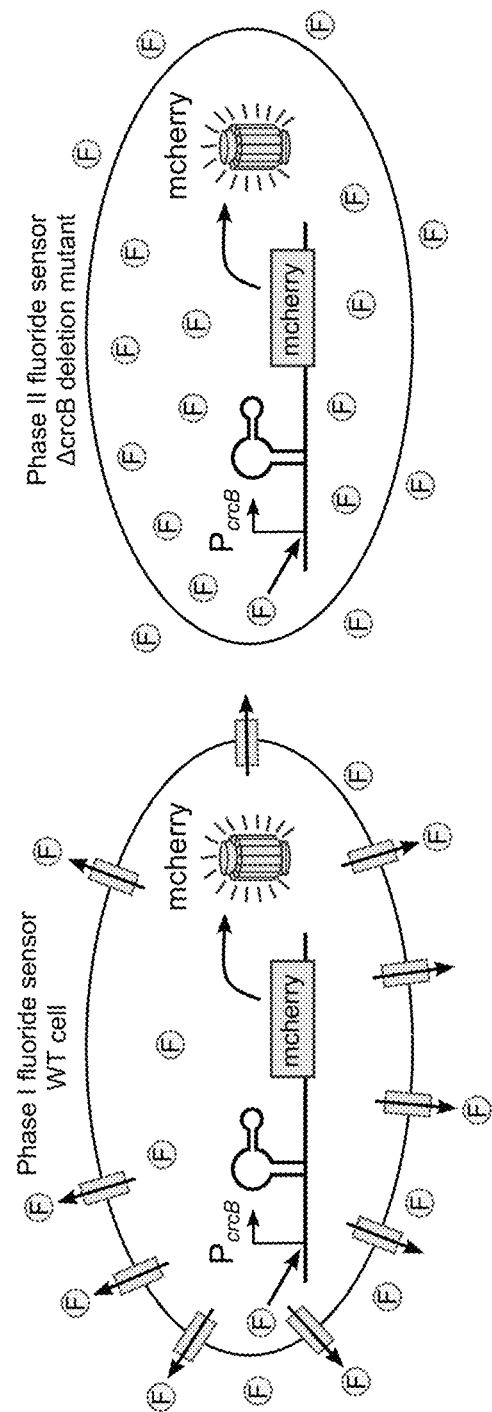
FIG. 45. shows a schematic illustration of a design to integrate and optimize a fluoride-detection capability in *C. crescentus* to provide a $UO_2F_2$ biosensor herein described.

FIG. 45 shows a schematic illustration of the approach. (Left) Phase I fluoride sensor: crcB-mCherry fusion built in wild type strain (Right). Phase II fluoride sensor: crcB-mCherry fusion built in strain deleted for fluoride export (ΔcrcB). Deletion of the crcB gene in *E. coli* improved the detection limit of a crcB-lacZ reporter by over 100-fold [102]. As such, this approach is expected to yield a fluoride-sensing capability that, when coupled with a U-sensing component herein described, will enable $UO_2F_2$ detection by *C. crescentus*.

Example 22 Reduction of the Fluoride Detection Limit by Manipulating the Expression Levels of the Native Fluoride Detoxification System/s in *C. crescentus*

*C. crescentus* possesses a putative fluoride ion transporter (CrcB) and withstands high mM concentrations of fluoride, suggesting native mechanism/s of fluoride detoxification. Prior data in *E. coli* indicate that the CrcB fluoride exporter functions to maintain low intracellular fluoride concentrations, adversely affecting the detection limit of the colorimetric crcB reporter (~1 mM). As such, the detection limit of phase 1 fluoride sensors development is expected to be significantly higher than the detection limit of our U sensor (~2 µM), and thus unlikely to be acceptable for nuclear effluent detection.

Accordingly, an analogous approach will be implemented as what allowed *E. coli* to yield a 100-fold improvement in the fluoride detection limit (sub 10 µM) [102]. Specifically, the function of the fluoride ion exporter will be abolished by deleting the crcB gene (encodes the CrcB fluoride exporter) in a strain containing the crcB-mCherry reporter (FIG. 45). Subsequently, crcB-mCherry fluorescence will be quantified over a range of NaF concentrations.

An analogous reduction in the F– detected limit in *C. crescentus* or other potential host organisms is expected be achieved through deletion of the crcB homolog or eriC$^F$, an analogous fluoride exporter. Both the CrcB and Eric$^F$ proteins have been previously defined. [102]

If deletion of crcB fails to improve crcB-mCherry performance or reduces the ability of *C. crescentus* to withstand high fluoride concentrations, the genes responsible for fluoride tolerance will be experimentally identified using one of two unbiased whole genome approaches: 1) RNA-seq to identify genes that increase in expression following fluoride exposure, and 2) transposon mutagenesis to screen for genes that, when inactivated, enhance the fluoride sensitivity of the crcB-mCherry reporter. The team successfully applied both approaches to identify the U-responsive regulators that form the basis of the whole-cell sensor [175].

One caveat of eliminating the native mechanism of fluoride efflux in *C. crescentus* is the reduced tolerance of cells to environmental fluoride. For example, the minimal inhibitory concentration of fluoride was reduced from 200 to slightly above 1 mM in an analogous *E. coli* crcB mutant. Since fluoride levels in groundwater, sea, and soil are typically in the 10-100 µM range [176], the reduced tolerance is not expected to be problematic except in the most highly concentrated environments.

If the *C. crescentus* crcB mutant will be too sensitive to fluoride (MIC<1 mM), the fluoride tolerance will be partly rescued by expressing the crcB fluoride exporter over a range of concentrations to identify levels that yield a desirable balance between the organism's fluoride tolerance and the sensitivity of the crcB-mCherry.

Example 23, Integration of Uranyl- and Fluoride-Sensing Components and Evaluate Detection Performance Under Aqueous Conditions A U-sensing AND gate circuit will be integrated with the optimal performing crcB-mCherry circuit within *C. crescentus* to enable UO$_2$F$_2$ detection. Two distinct configurations will be constructed and further characterized.

Figure 47:
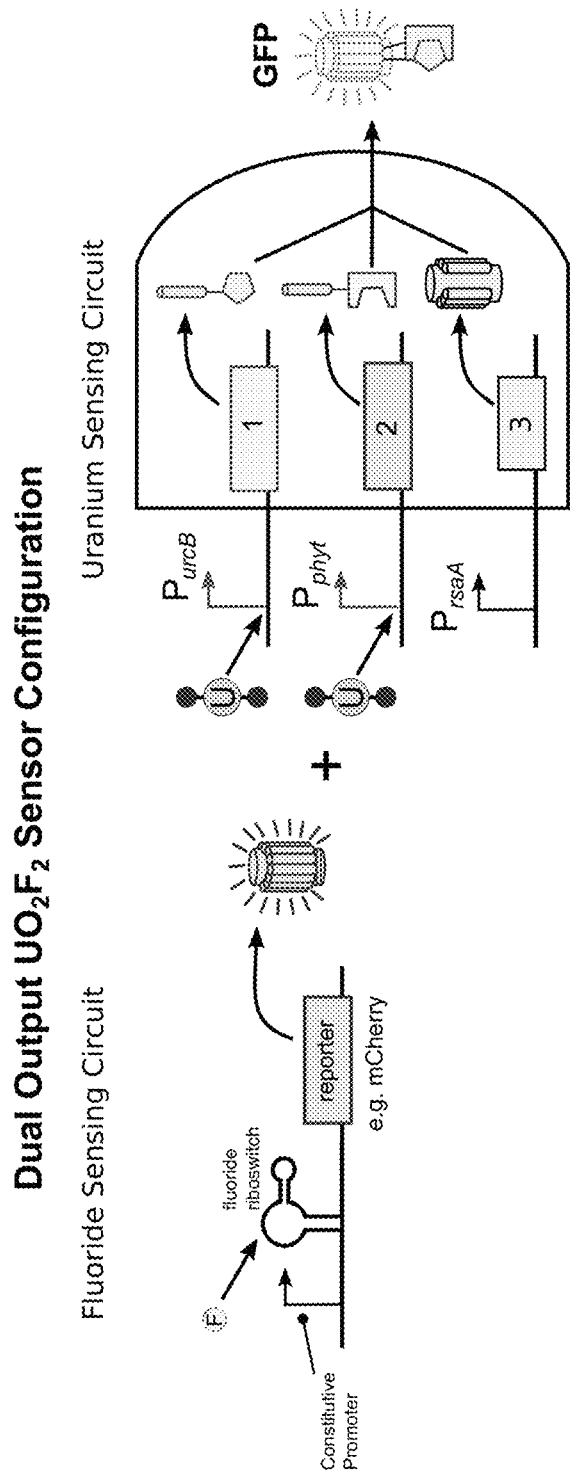
FIG. 47 shows a schematic representation of an exemplary dual output configurations of a $UO_2F_2$ biosensor herein described.

FIGS. 46 and 47 show a schematic illustration of the related approach.

The configurations of the exemplary UO$_2$F$_2$-biosensors of FIG. 46 and FIG. 47 will provide an individual readout of uranium and fluoride levels and provides a safeguard for environments where natural uranium or fluoride occur at elevated levels. Uranium occurs naturally at concentrations of ~10-100 ppb in soils and ~5-100 s of ppb in ground water [37] while fluoride levels in groundwater, sea, and soil are typically in the 10-100 µM range [176].

Continuous environmental monitoring with the biosensor is expected to identify significant deviations from background levels for either or both analytes that it is expected to signify an anthropogenic release. This circuit configuration also enables the flexibility to individually adjust the sensitivity of the U and F detection components to suit the specific application or region of interest and in particular a lower fluoride detection limit (compared to U) may be acceptable if the whole cell sensor is integrated with an air-sampling device that collects UO$_2$F$_2$ aerosols and HF formed from atmospheric hydrolysis of UF$_6$.

Specific configurations are exemplified in Example 24 and 25.

Example 24: UO$_2$F$_2$ Single Output Biosensor Configuration: Integrated Uranium- and Fluoride-Sensing Components within an AND Gate Circuit A UO$_2$F$_2$ sensor 2 will be constructed with an integrated uranium- and fluoride-sensing components within an AND gate circuit such that GFP fluorescence is produced only when the cell perceives both U and fluoride.

In particular, uranium- and fluoride-sensing components can be integrated within a configuration such that a single reporter molecule (e.g., mCherry, GFP) is produced only when the cell perceives both U and fluoride.

Examples of single output UO$_2$F$_2$ biosensor configuration are shown in FIG. 46

In particular in FIG. 46 panel A a configuration is schematically illustrated wherein uranium- and fluoride-sensing components are integrated in series. The promoter can be any UzcR- or UrpR-regulated promoter (defined in prior patent app) such that U-dependent transcription is initiated by UzcR or UrpR. In this circuit, transcription will be prematurely terminated by the fluoride sensing riboswitch in the absence of fluoride (i.e., not detectable output). Binding of fluoride to the riboswitch will mediate transcriptional read-through and ultimately, production of the reporter.

In FIG. 46 panel B a configuration is schematically illustrated wherein uranium- and fluoride-sensing components integrated in series where U-dependent transcriptional activation requires the function of both UrpR and UzcR. Will provide greater selectivity for uranium compared to the sensors described in panel A. However, in this configuration, the sensitivity for U would be limited by the UzcRS component.

In FIG. 46 panel C a configuration is schematically illustrated wherein integration of the fluoride riboswitch within the AND gate circuit such that expression of component three requires fluoride exposure. In this configuration, reconstitution of GFP fluorescence requires activation of the two uranium-responsive pathways and fluoride binding to the fluoride riboswitch. Transcription of component three can theoretically be controlled by any constitutive promoter. The assignment of each component with the given regulatory promoter is arbitrary and easily swapped. For example, the fluoride riboswitch could be used to control expression of component one or two.

The single output of this configuration simplifies detection and will be most useful for an all-or-none screening function that fluoresces when threshold U and fluoride levels are encountered. The sensitivity of detection would be theoretically limited by the least sensitive component.

The single output of this configuration also simplifies standoff detection and will be most useful for an all-or-none screening function that fluoresces when threshold U and fluoride levels are encountered.

While the sensitivity of detection would be theoretically limited by the least sensitive component, this configuration will focus on improving the sensitivity of the U and fluoride components. To construct the UO$_2$F$_2$ sensor 2, the crcB riboswitch will be integrated within the state-of-the art AND gate circuit exemplified in the present disclosure such that expression of component three requires fluoride exposure.

In this configuration, reconstitution of GFP fluorescence requires activation of the two uranium-responsive pathways and fluoride binding to the crcB riboswitch.

Example 25 UO$_2$F$_2$ Dual Output Biosensor Configuration with Uranium and Fluoride-Sensing Riboswitch in Separate Circuits with Different Output Reporter Uranium- and fluoride-sensing components can be integrated within a configuration such that integrated uranium- and fluoride-sensing components are provided as separate components or separate circuits with different output reporters (Dual Output UO$_2$F$_2$ Sensor)

Exemplary configurations of a dual output UO$_2$F$_2$ biosensor are shown in FIG. 47

In particular, in FIG. 47 an exemplary sensor 1 is schematically described in comprising a U-sensing genetic circuit and a separate a Fluoride sensing reportable genetic molecular components.

In the illustration of FIG. 47, the U-sensing genetic circuit comprises a reportable genetic molecular component which is expressed when the genetic circuit operates according to the circuit design in presence of bioavailable U. in the exemplary illustration of FIG. 47, the reportable component is the GFP protein which is expressed upon expression of a first U-sensing genetic molecular component comprising a PUzcrB promoter encoding for a first component of the GFP protein, a second U sensing component comprising a P$_{phyt}$ promoter and encoding for a second component of the GFP protein and a genetic molecular component a third component of the GFP protein under an exemplary active constitutive promoter (rsA).

In the illustration of FIG. 47, the Fluoride sensing reportable genetic molecular component is a genetic reportable molecular component expresses the fluorescent reporter mCherry within a gene comprising a Fluoride sensing riboswitch under the control of an crcB promoter to provide a Fluoride sensing component.

To construct the biosensor in the output configuration schematically illustrated in exemplary FIG. 47, the optimal performing crcB-mCherry fusion will be integrated into the chromosome of a *C. crescentus* strain that already contains the tripartite GFP U-sensing AND gate. As such, mCherry and GFP fluorescence can be quantified to provide a separate readout of environmental fluoride and U levels.

In particular the variation of the biosensor described therein is shown in FIG. 47 wherein in the fluoride sensing reportable genetic molecular component the fluorescent reporter mCherry within a gene comprising a Fluoride sensing riboswitch is under the control of an active constitutive promoter to provide a Fluoride sensing component.

This configuration will provide an individual readout of uranium and fluoride levels and provides a safeguard for environments where natural uranium or fluoride occur at elevated levels. Uranium occurs naturally at concentrations of ~10-100 ppb in soils and ~5-100 s of ppb in ground water [37] while fluoride levels in groundwater, sea, and soil are typically in the 10-100 μM range.

Continuous environmental monitoring with the biosensor could identify significant deviations from background levels for either or both analytes that could signify an anthropogenic release. This circuit configuration also enables the flexibility to individually adjust the sensitivity of the U and F detection components to suit the specific application or region of interest—a lower fluoride detection limit (compared to U) may be acceptable if the whole cell sensor is integrated with an air-sampling device that collects UO$_2$F$_2$ aerosols and HF formed from atmospheric hydrolysis of UF$_6$. To construct this sensor, the fluoride riboswitch will be placed downstream of a constitutive promoter and upstream of a reporter (e.g., mCherry), such that transcription of the reporter occurs only in the presence of fluoride. This crcB-mCherry fusion will be employed in tandem with the tripartite GFP U-sensing AND gate. As such, mCherry and GFP fluorescence can be quantified to provide a separate readout of environmental fluoride and U levels.

Example 26: F-Sensing Riboswitch of Host Bacteria Knocked Out

To mitigate fluoride toxicity, many bacteria employ a fluoride export protein (e.g., CrcB or Eric$^F$ that functions to maintain low cytoplasmic fluoride concentrations.

Prior data in *E. coli* indicate that this CrcB-mediated fluoride exporter adversely affects the detection limit of the colorimetric crcB reporter (~1 mM) as a consequence of the low intracellular fluoride concentrations.

A similar fluoride export activity is expected in *C. crescentus* since *C. crescentus* possesses an annotated CrcB transporter with high amino acid sequence similarity to previously characterized CrcB fluoride-specific ion channels [177] and tolerates high mM concentrations of fluoride.

Accordingly, to achieve a fluoride detection limit on par with the U detection limit of our sensor (~1 μM), we will implement an analogous approach as that in *E. coli*, which yielded a 100-fold improvement in the fluoride detection limit (sub 10 μM) and maintained a dynamic range that spanned two orders of magnitude. [102].

Figure 49:
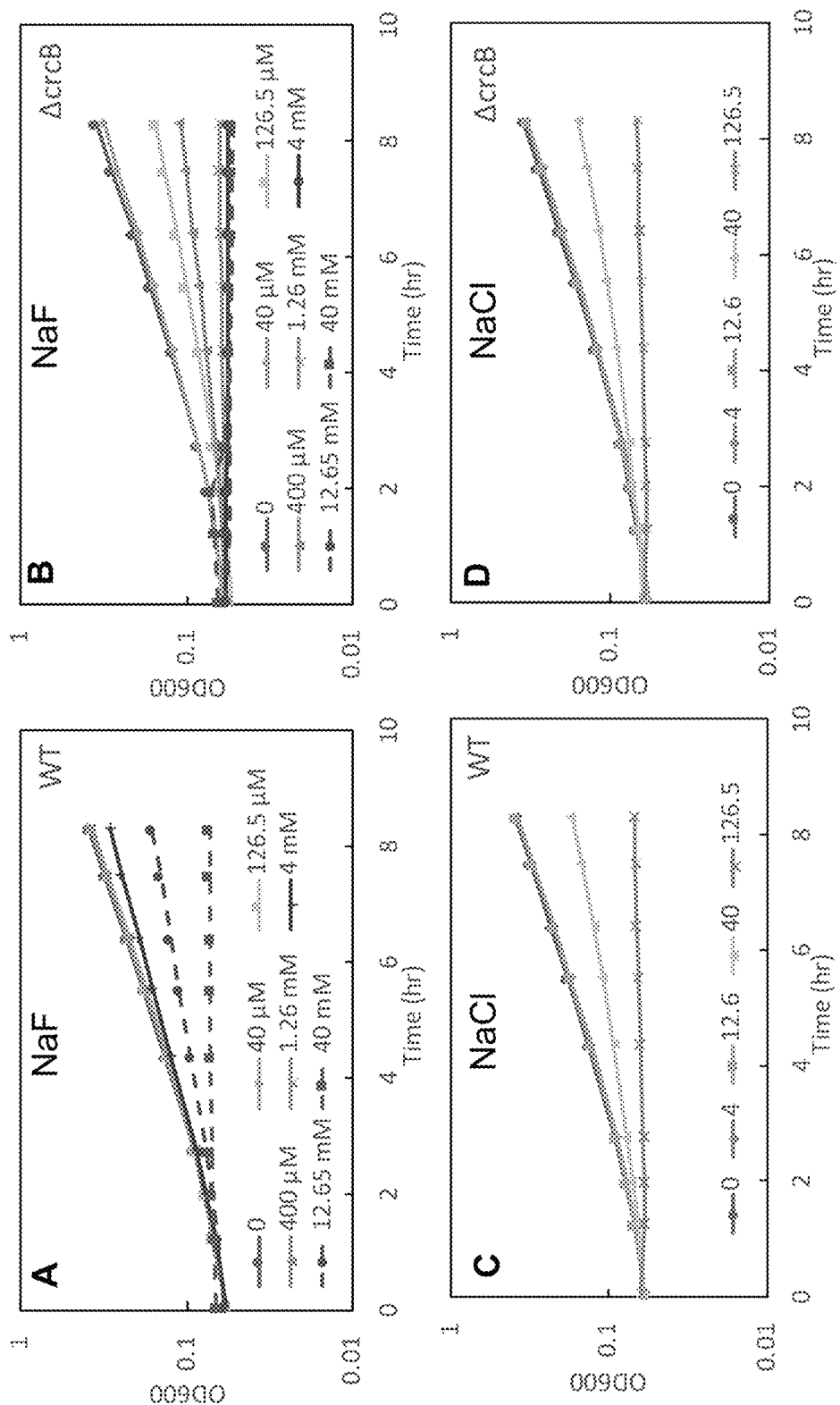
FIG. 49 shows charts reporting the effect of crcB deletion on the growth of *Caulobacter crescentus* in the presence of NaF and NaCl.

Specifically, the function of the fluoride ion exporter in *C. crescentus* was tested by monitoring the growth of a strain deleted for crcB in the presence of NaF and NaCl (FIG. 49).

The results illustrated in FIG. 49 panels A and B show growth defect is observed for WT at NaF concentrations above 4 mM and for the crcB deletion strain at concentrations above 126.5 μM, marking a greater than 30-fold reduction in Fluoride tolerance in the absence of the fluoride efflux pump.

The results illustrated in FIG. 49 panels C and D show that growth of *C. crescentus* in the presence of NaCl is unaffected by deletion of crcB. These data confirm the role of *C. crescentus* CrcB in fluoride efflux.

Importantly, the growth profile of the crcB deletion strain was indistinguishable from WT over a range of NaCl concentrations (FIG. 49 panel B), supporting a specific role for *C. crescentus* CrcB in fluoride efflux.

Example 27: Comparison of Riboswitches Performance in a LacZ Fusion Construct

Figure 55:
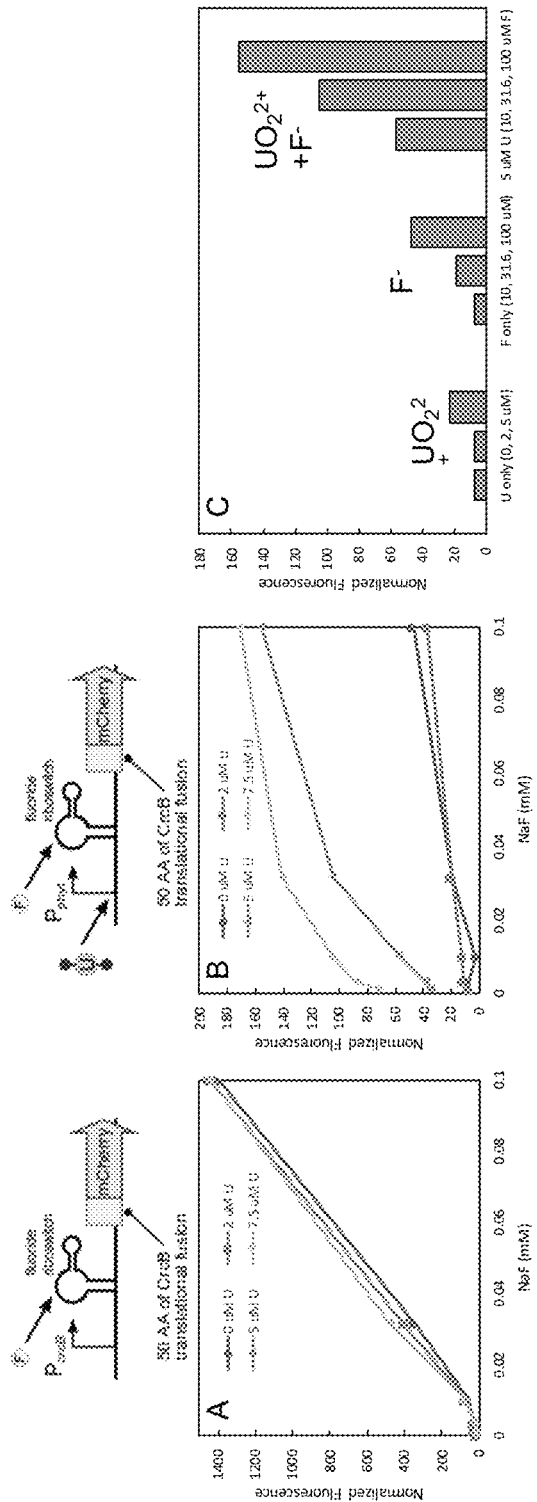
FIG. 55 shows charts reporting the testing of an in-series uranyl fluoride sensing circuit.

To enable detection of fluoride in *C. crescentus*, a fluoride sensing riboswitch [102] will be employed to control the expression of a fluorescent reporter (e.g., mCherry) such that fluoride detection results in cell fluorescence (FIG. 55).

Since *C. crescentus* lacks a native fluoride riboswitch, a library of riboswitch reporters (transcriptional fusions to mCherry) was built and screened that included the well-characterized fluoride riboswitches from *P. syringae* DC3000 [102] and previously uncharacterized fluoride riboswitches from *Sphingomonas* sp. MM-1 and *Sphingomonas* sp. 67-36, which are closely related to *C. crescentus* and possesses similarly high genomic G+C content (66%) (FIG. 50 Panels A to D).

The sequences of the riboswitches and related constructs are reported in Table 13 below.

TABLE 13

Sequences of tested riboswitches

| Construct including Riboswitch | Sequence | SEQ ID NO |
|---|---|---|
| Translational lacZ fusion comprising a Sphingomonas MM-1 riboswitch | CAGAGATCTAACGCCAGTTACAGCACGCG TGGCGAAGGGCGCGATCGAGGTGGCCGCG CCGGCTGGGTGACGGGCTGCCATTGACGC GCTGCCCCACCCCCGCCATATCGTCGGCA ACGGCAATGGATTCCTGCCGGGCCTCGCG CCGAACCGCCATTGAGGGCTGATGATTCC TACCTGCGGCCGCCCTGCGGCAAGGAGGA ATCATGCGTTCGGTATTTCTCGTCTTGGT ACCTGC | 2515 |
| Translational lacZ fusion comprising Sphingomonas 67-36 riboswitch sequence | CAGAGATCTGCCGACAAGGCCAAGAAGCT CGGCATCCCGGTCTGGAGGTTCGGCGGCG CGTAAGCGCCGCCCCGACCTCTACCAAGA GCCGATCTCTTTCGATATCATGCATGGTG ACGGGGATGGAGTTCCCCGATAACCGCCG TTCCGGGCTGATGACTCCTACCAACACAG GCAACCCGCCCGTCGATGGTAGGTGTTCG CCTTCGACTGGTACCTGC | 2516 |
| Translational lacZ fusion comprising Pseudomonas syringae riboswitch sequence | CAGAGATCTTTTGGCCCTCTTTCGTAAGC GGTGACTCGAAGACGCCTTCGCTTGCCTC GTACTCCGAAACACGATTTTACATTTTGG ACAGACCTAGCTAAGATCGGCGCATTGGA GATGGCATTCCTCCATTAACAAACCGCTG CGCCCGTAGCAGCTGATGATGCCTACAGA AACCTGATCAAACCAGGTCTGTAGGCGTT CGCGCTTAGAATCCCTTCTTTGGTCAGGC CCACTTATTTTTTGTGGCTGGCCAAATGT CTAAATTTCGACGACCTGAGGTACCTGC | 2517 |

The function of the fluoride riboswitches was tested in *C. crescentus* initially using translational lacZ fusions with the associated native crcB or eric$^F$ promoters schematically illustrated in FIG. 50 panel A.

In particular the function of fluoride riboswitches from three different bacteria was tested in *Caulobacter crescentus* with a construct in which each riboswitch was included between a Pcrcb and a LacZ reporter (FIG. 50 Panel A)

In particular, DNA sequence spanning from 197 and 180 nucleotides upstream of the start codon for *Sphingomonas* MM-1 and 67-36, respectively, through the first 7 amino acids of the crcB gene was fused to lacZ to produce a translational fusion. A DNA sequence range from 236 nucleotides upstream of the start codon through the first 11 amino acids of the Eric$^F$ efflux pump was used for *Pseudomonas* syringae.

The results reported in FIG. 50 Panels B to D indicate a difference in performance of the different riboswitches in the construct schematically described in FIG. 50, Panel A.

In particular, the fluoride riboswitch from *Sphingomonas* MM-1 was responsive to fluoride and had the largest dynamic range and signal amplitude (FIG. 50 Panel B), while the riboswitch from *Sphingomonas* 67-36 was non-responsive to fluoride (FIG. 50 Panel D).

In particular, the construct for *Sphingomonas* 67-36 lacked fluoride induction, which is expected to reflect a lack of a promoter sequence in the construct or weak promoter activity in *C. crescentus*.

The riboswitch from *Pseudomonas syringae* was also fluoride responsive, but had a lower dynamic range compared to the riboswitch from MM-1 (FIG. 50 Panel C).

Importantly, this set of experiments further evidenced that the crcB deletion strain significantly improved the F$^-$ sensitivity compared to WT with induction occurring at almost two orders of magnitude lower F$^-$ concentration.

An additional LacZ fusion including *Sphingomonas* MM-1 riboswitch sequence with a reduced G+C content is (SEQ ID NO: 2527)
CAGAGATCTAACGCCGGTGACGGCGCGCGTGGCGAAGGGCGCGATCGAGGT

GGCCGCGCCGGCTGGGTGACGGGCTGCCATTGACGCGCTGCCCCACCCCCG

CCATATCGTCGGCAACGGCAATGGATTCCTGCCGGGCCTCGCGCCGAACCG

CCATTGAGGGCTGATGATTCCTACCTGCGGCCGCCCTGCGGCAAGGAGGAA

TCATGCGTTCGGTATTTCTCGTCTTGGTACCTGC.

Example 28: Modularity of Exemplary Riboswitches

The function of each riboswitch outside of the context of the native promoter was tested to determine the modularity with respect to the promoter sequence.

Modularity with respect to the promoter is critical feature for a fluoride riboswitch-based sensor since this would allow the use of a strong constitutive promoter (to improve the signal amplitude) and a U-sensitive promoter to enable detection of $UO_2F_2$.

Figure 51:
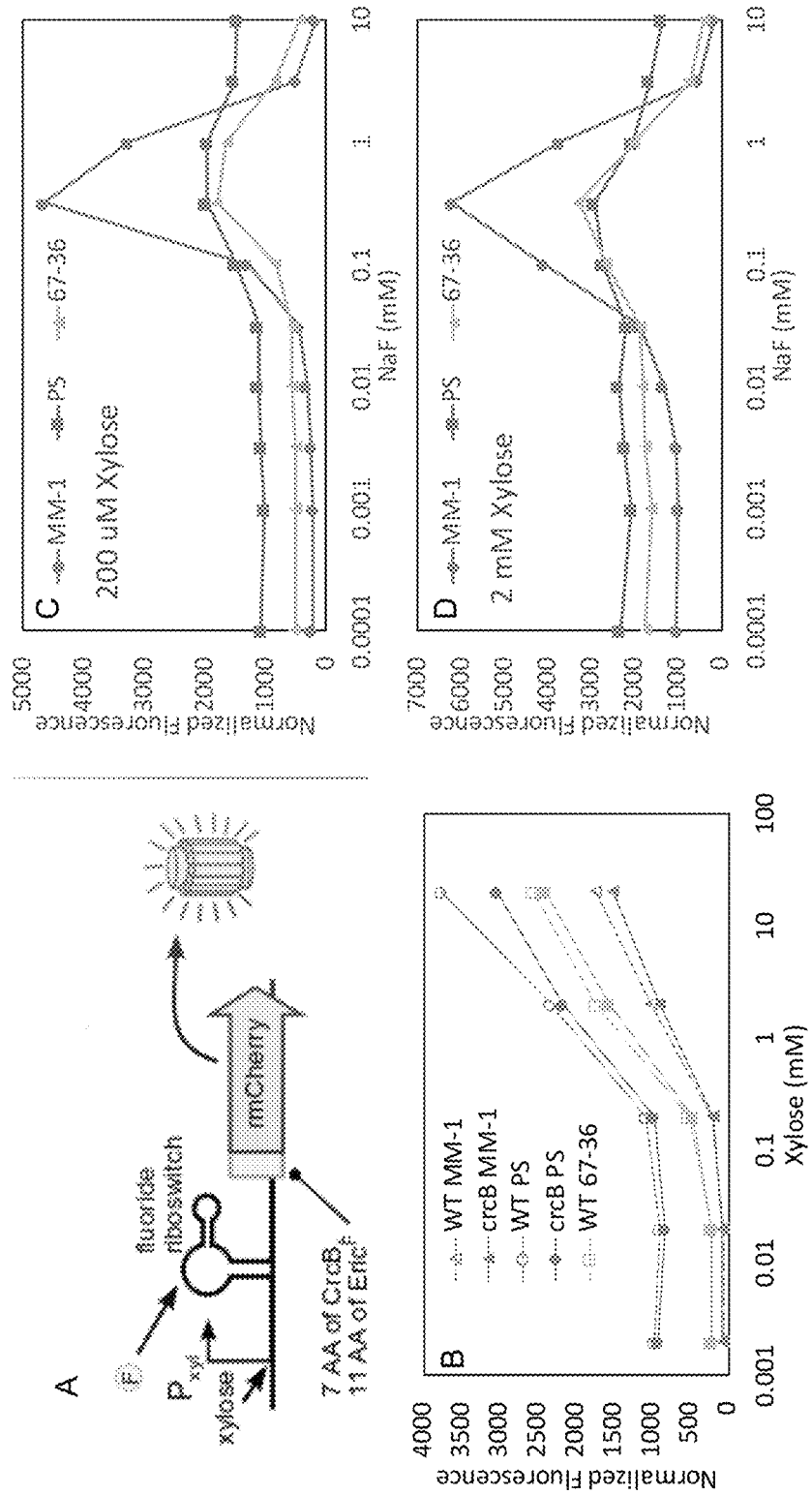
FIG. 51 shows a schematic and charts illustrating fluoride responsiveness of fluoride riboswitches from three different bacteria tested in *C. crescentus* using the xylose inducible promoter.
Figure 51:
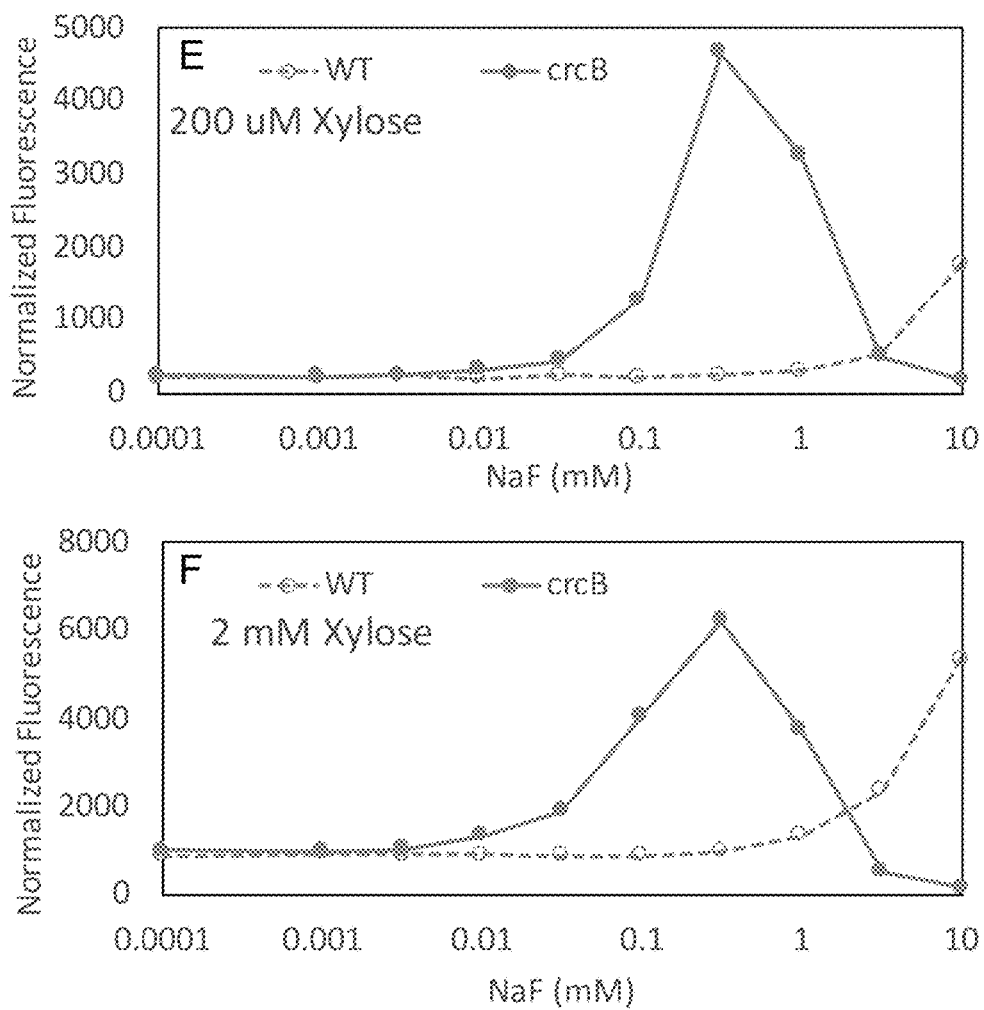

To this end, DNA sequence 97, 146, and 80 bp upstream of the start codon for *Sphingomonas* MM-1, *Pseudomonas syringae*, and *Sphingomonas* 67-36, respectively was fused to the xylose inducible promoter (Pxyl) and to mCherry in a construct schematically illustrated in FIG. 51 Panel A. P, was employed since it allows a wide range of promoter activities to be assayed (FIG. 51 Panel A).

The sequences of each riboswitch is reported in Table 14 below

TABLE 14

Sequences of tested riboswitches

| Construct including Riboswitch | Sequence | SEQ ID NO |
|---|---|---|
| Pxyl regulated translational mCherry fusion comprising Sphingomonas MM-1 riboswitch sequence | tgccgacgaacgcgcATATCGTCGGCAA CGGCAATGGATTCCTGCCGGGCCTCGCG CCGAACCGCCATTGAGGGCTGATGATTC CTACCTGCGGCCGCCCTGCGGCAAGGAG GAATCATGCGTTCGGTATTTCTCGTCAT GGTGAGCAAGGGG | 2518 |
| Pxyl regulated translational mCherry fusion comprising Sphingomonas 67-36 riboswitch sequence | tgccgacgaacgcgcTCATGCATGGTGA CGGGGATGGAGTTCCCCGATAACCGCCG TTCCGGGCTGATGACTCCTACCAACACA GGCAACCCGCCCGTCGATGGTAGGTGTT CGCCTTCGAATGGTGAGCAAGGGG | 2519 |
| Pxyl regulated translational mCherry fusion comprising Pseudomonas syringae riboswitch sequence | tgccgacgaacgcgcAAGATCGGCGCAT TGGAGATGGCATTCCTCCATTAACAAAC CGCTGCGCCCGTAGCAGCTGATGATGCC TACAGAAACCTGATCAAACCAGGTCTGT AGGCGTTCGCGCTTAGAATCCCTTCTTT GGTCAGGCCCACTTATTTTTTGTGGCTG GCCAAATGTCTAAATTTCGACGACCTAT GGTGAGCAAGGGG | 2520 |

The fluoride responsiveness of the fluoride riboswitches in such construct was tested in *C. crescentus* to test the compatibility of each riboswitch with a non-native promoter to test the modularity of the riboswitch.

Fluorescence was monitored as a function of xylose and NaF concentrations.

The results illustrated in FIG. 51 Panel B show that expression of mCherry remains low in the absence of fluoride at xylose concentrations up to 200 uM. However, high concentrations of xylose (2-20 mM) lead to partial fluoride-independent activation. This result suggests that a single fluoride riboswitch is insufficient to halt all transcription initiation events when promoter activity is high.

The results illustrated in FIG. 51 Panels C and D show that while all three riboswitches were responsive to fluoride, the riboswitch from *Sphingomonas* MM-1 exhibited the largest dynamic range, which is in agreement with the lacZ fusion data reported in Example 27 and FIG. 50.

These results suggest that the fluoride riboswitch from *Sphingomonas* MM-1 is modular with respect to the promoter sequence and the most suitable for application in *C. crescentus*. It is expected that a further optimization of the native Shine Dalgarno sequence will enhance the dynamic range and signal amplitude of the *Pseudomonas syringae* riboswitch construct.

The results of the experiments related to placement of the MM-1 riboswitch downstream of the xylose-inducible promoter (Pxyl), also indicated that at high concentrations of xylose (2-20 mM) lead to partial fluoride-independent activation.

This result suggests that a single fluoride riboswitch can be insufficient to halt all transcription initiation events when promoter activity is high. In those cases, a second MM-1 riboswitch, added in tandem, is expected to increase the probability of terminating transcription in the absence of fluoride, which will reduce the level of fluoride-independent activation and is also expected to increase the dynamic range. Preferably, when two riboswitches are placed in tandem, the first riboswitch does not contain the native RBS or downstream protein coding sequence.

In addition, it is also expected that addition of a spacer DNA region between the DNA region encoding each riboswitch will increase performance of the F-sensing element with MM-1 riboswitches. A non-structured DNA of 10-50 bp is expected to be sufficient (preferably with a shorter sequence to minimize the length of the this 5' untranslated region). If the RBS and downstream protein coding sequence cannot be removed without losing fluoride binding activity, then the DNA encoding the first 50 amino acids can be fused to the first riboswitch and terminated with a stop codon.

The results illustrated in FIG. 51 Panels E and F further show that the crcB deletion strain has significantly improved F− sensitivity compared to WT. These results further confirm that the crcB deletion background can be employed for all subsequence experiments to maximize fluoride sensitivity.

The above results support the use of the *Sphingomonas* MM-1 fluoride riboswitch in a crcB deletion background for subsequent experiments.

Example 29: Effects of Different Fusion Lengths and Attenuators on Fluoride Detection of F Sensing Riboswitches In order to test the length of the fusion including a fluorescence protein [113] further experiment have been performed to identify the lengths and associated fluoride detection to identify an optimized length.

In particular, the effect of two different translational fusion lengths (7 and 50 amino acids) and two so-called ribo-attenuators (ATT2 and ATT3) [113], which are genetic elements designed for increased ribosome modularity through predictable tuning, insulation from contextual changes, and a reduction in expression variation.

Accordingly, the DNA encoding 0, 7, and 50 amino acids of *Sphingomonas* MM-I CrcB was fused to mCherry and the native crcB promoter was used to drive expression of the riboswitch reporter construct A transcriptional mCherry fusion was also tested, where the crcB gene and the shine Dalgarno sequence were deleted from the construct.

Figure 54:
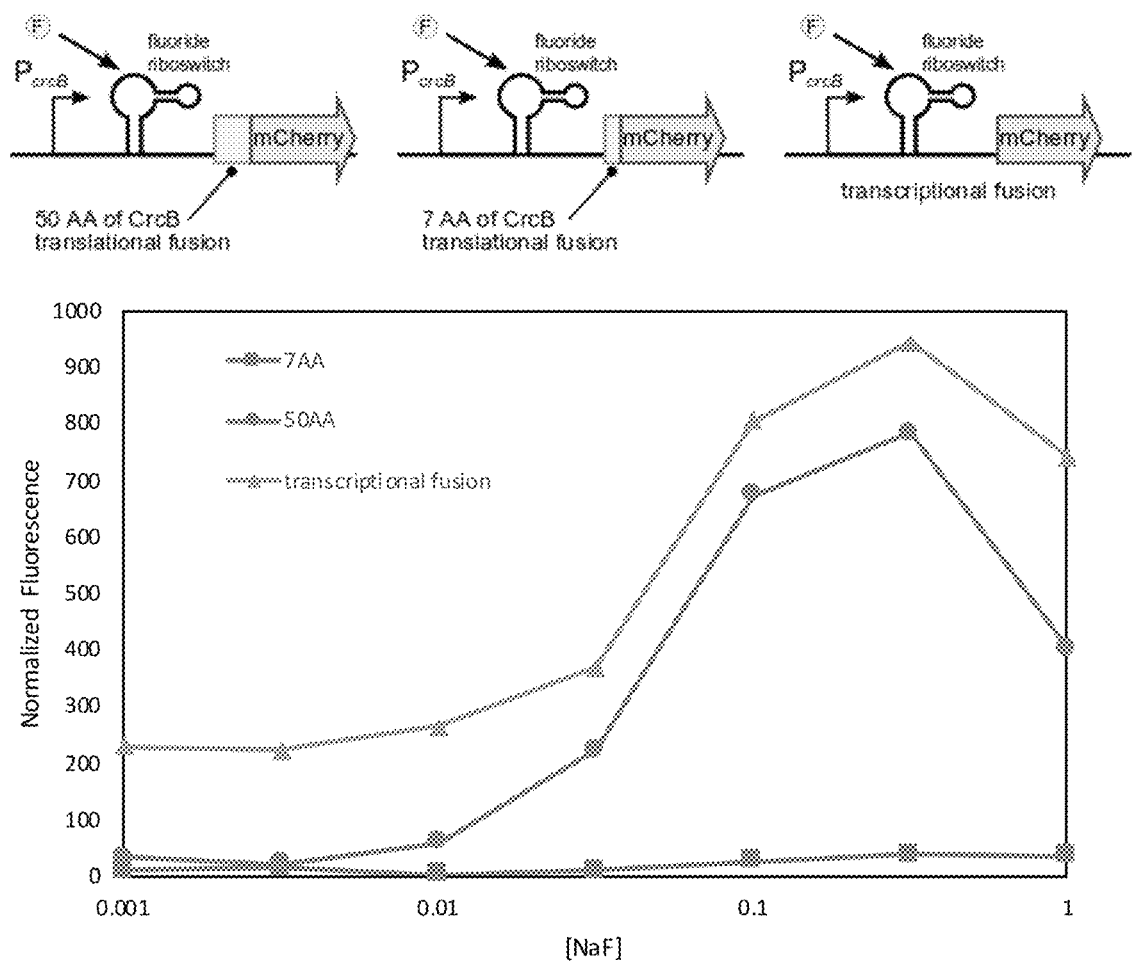
FIG. 54 show the effect of translational fusion length on *Sphingomonas* MM-1 fluoride riboswitch function.

The results reported in FIG. 54 show that the constructs containing either a 50 AA translational fusion or a transcriptional fusion exhibited a fluoride-dependent increase in fluorescence, whereas the 7 AA translational fusion was only very weakly responsive to fluoride (FIG. 54).

These data suggest that the MM-I riboswitch can function independently of its native crcB gene and that a longer translational fusion with mCherry is preferred vs a shorter fusion in the context of MM-I riboswitch function, Example 30: Selection of Promoters and F Sensing Riboswitches for an F-Sensing Genetic Reportable Molecular Component To develop a uranyl fluoride sensor, the UrpRS regulated promoter $P_{Phyt-short}$ was integrated upstream of the MM-I riboswitch, replacing the native crcB promoter. The native shine Dalgarno sequence for the crcB gene was not modified and a translational rCherry promoter was constructed with the first 150 nucleotides (50 amino acids) of the crcB gene. While the presence of U or fluoride alone yielded a minor increase in fluorescence, the presence of both U and fluoride yielded the highest fluorescence increase, confirming the intended functionality of the circuit (FIG. 55 Panels B and C). In contrast, the control fluoride sensor containing the native crcB promoter was unresponsive to uranium MM-1 fluoride sensing circuit with native crcB promoter is not responsive to U. (B) A uranyl fluoride sensing circuit constructed by combining the UrpRS-responsive Pphyt promoter with the MM-1 riboswitch. (C) Depicts the fluorescence of the uranyl fluoride sensing circuit in the presence of U alone, F alone, and both U and F. Tests-were performed with F−, added as NaF, and uranyl, added as uranyl nitrate. The presence of both U and fluoride yields the highest signal amplitude.

Example 31: Selection of Promoters and F Sensing Riboswitches for an F-Sensing Genetic Reportable Molecular Component The following approach can be followed to optimize promoter for a bacterial host and application of interest for cassettes where U and F sensing components are placed in different circuits (e.g., FIG. 46C; FIG. 47).

The consensus promoter sequence for the housekeeping sigma factor (sigma73) in *Caulobacter crescentus* has been previously determined [178].

For optimal fluoride riboswitch reporter function, mutating the native crcB/eric$^F$ promoter toward the *C. crescentus* consensus is recommended. For example, it is expected that mutating the −10 region of the *Sphingomonas* MM-1 crcB promoter from 5'-GCCATATC-3' (SEQ ID NO: 2521) to 5'GCTATATC-3' (SEQ ID NO: 2522) will enhance the signal amplitude of the fluoride sensing reporter. The optimal functional fluoride reporter can be integrated within a *C. crescentus* strain containing a U-sensing promoter (any from prior patent app) for a two-color output (e.g., FIG. 47) or integrated within the U sensing AND gate (two U-responsive components and one F-responsive component (e.g., FIG. 46C)) for a single-color output.

Example 32: Selection of Promoters and F Sensing Riboswitches for a U Sensing F-Sensing Genetic Reportable Molecular Component For application wherein the optimization is desired when combining a U-responsive promoter with a fluoride riboswitch (e.g., FIG. 46B-C) to place the U-responsive and F-responsive components within a single circuit, the native crcB promoter can be replaced with a uranium responsive promoter (any UzcRS or UrpRS promoter). For example, The $P_{phyt}$-short promoter was added upstream of the *Sphingomonas* sp MM-1 fluoride riboswitch and exhibited the highest fluorescent output signal in the presence of uranyl and fluoride. It is anticipated that the signal amplitude can be further improved by optimizing the RBS as described below. Furthermore, the F-independent output signal is expected be reduced by adding a second riboswitch sequence, resulting in an improve dynamic range.

Example 33: Selection of RBS Sequence for Inclusion in F-Sensing Component and U-Sensing F-Sensing Components Since the fluoride riboswitch has been shown to function through a mechanism of transcriptional termination, the ribosome binding site is likely amenable to optimization. The RBS can be optimized using the standard registry of parts (http://parts.igem.org/Main_Page at the date of filing of the instant application), which contains several well-characterized RBS sequences that are likely to work in a broad range of host organisms. For example, it is expected that swapping the native *Sphingomonas* crcB RBS (5'-AAGGAGGAATCATG-3') (SEQ ID NO: 2523) with the potent 5'-AAGGAGGAAAAACATATG-3' RBS (SEQ ID NO; 2524) will improve the dynamic range.

In summary described herein are U biosensors, and related U-sensing genetic molecular components, genetic circuits, compositions, methods and systems are described, which in several embodiments can be used to detect and/or neutralize uranium and in particular bioavailable U.

The examples set forth above are provided to give those of ordinary skill in the art a complete disclosure and description of how to make and use the embodiments of the U biosensors, and related U-sensitive genetic molecular components, genetic circuits, compositions, methods and systems of the disclosure, and are not intended to limit the scope of what the inventors regard as their disclosure. Those skilled in the art will recognize how to adapt the features of the exemplified U biosensors, and related U-sensitive genetic molecular components, genetic circuits, compositions, methods and systems herein disclosed to additional U biosensors, and related U-sensitive genetic molecular components, genetic circuits, compositions, methods and systems, and related genetic molecular components, sets of polynucleotides, polypeptides, proteins, and/or metabolites, in according to various embodiments and scope of the claims.

All patents and publications mentioned in the specification are indicative of the levels of skill of those skilled in the art to which the disclosure pertains.

The entire disclosure of each document cited (including patents, patent applications, journal articles, abstracts, laboratory manuals, books, or other disclosures) in the Background, Summary, Detailed Description, and Examples is hereby incorporated herein by reference. All references cited in this disclosure are incorporated by reference to the same extent as if each reference had been incorporated by reference in its entirety individually. However, if any inconsistency arises between a cited reference and the present disclosure, the present disclosure takes precedence. Further, the computer readable form of the sequence listing of the ASCII text file IL13081B-P2326-US-SEQ-LISTING_ST25-2020-04-27 created on Apr. 27, 2020 is incorporated herein by reference in its entirety.

The terms and expressions which have been employed herein are used as terms of description and not of limitation, and there is no intention in the use of such terms and expressions of excluding any equivalents of the features shown and described or portions thereof, but it is recognized that various modifications are possible within the scope of the disclosure claimed.

Thus, it should be understood that although the disclosure has been specifically disclosed by embodiments, exemplary embodiments and optional features, modification and variation of the concepts herein disclosed can be resorted to by those skilled in the art, and that such modifications and variations are considered to be within the scope of this disclosure as defined by the appended claims.

It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise. The term "plurality" includes two or more referents unless the content clearly dictates otherwise. Unless defined otherwise, all technical and scientific terms used herein have the same meaning as commonly understood by one of ordinary skill in the art to which the disclosure pertains.

When a Markush group or other grouping is used herein, all individual members of the group and all combinations and possible sub-combinations of the group are intended to be individually included in the disclosure. Every combination of components or materials described or exemplified herein can be used to practice the disclosure, unless otherwise stated. One of ordinary skill in the art will appreciate that methods, system elements, and materials other than those specifically exemplified may be employed in the practice of the disclosure without resort to undue experimentation. All art-known functional equivalents, of any such methods, device elements, and materials are intended to be included in this disclosure. Whenever a range is given in the specification, for example, a temperature range, a frequency range, a time range, or a composition range, all intermediate ranges and all subranges, as well as, all individual values included in the ranges given are intended to be included in the disclosure. Any one or more individual members of a range or group disclosed herein may be excluded from a claim of this disclosure. The disclosure illustratively described herein suitably may be practiced in the absence of any element or elements, limitation or limitations which is not specifically disclosed herein.

A number of embodiments of the disclosure have been described. The specific embodiments provided herein are examples of useful embodiments of the disclosure and it will be apparent to one skilled in the art that the disclosure can be carried out using a large number of variations of the genetic circuits, genetic molecular components, and methods steps set forth in the present description. As will be obvious to one of skill in the art, methods and systems useful for the present methods and systems may include a large number of optional composition and processing elements and steps.

In particular, it will be understood that various modifications may be made without departing from the spirit and scope of the present disclosure. Accordingly, other embodiments are within the scope of the following claims.

REFERENCES

1. Miller, J., *Experiments in molecular genetics*. Cold Spring Laboratory Press. 1972, Cold Spring Harbor, NY.
2. Ku, H., *Notes on the use of propagation of error formulas*. Journal of Research of the National Bureau of Standards, 1966. 70(4).
3. Park, D. M., et al., *Identification of a U/Zn/Cu responsive global regulatory two-component system in Caulobacter crescentus*. Mol Microbiol, 2017.
4. Fisher, J. A., J. Smit, and N. Agabian, *Transcriptional analysis of the major surface array gene of Caulobacter crescentus*. J Bacteriol, 1988. 170(10): p. 4706-13.
5. Cabantous, S., et al., *A new protein-protein interaction sensor based on tripartite split-GFP association*. Scientific reports, 2013. 3: p. 2854.
6. Meisenzahl, A. C., L. Shapiro, and U. Jenal, *Isolation and characterization of a xylose-dependent promoter from Caulobacter crescentus*. J Bacteriol, 1997. 179(3): p. 592-600.
7. Newsome, L., K. Morris, and J. R. Lloyd, *The biogeochemistry and bioremediation of uranium and other priority radionuclides*. Chemical Geology, 2014. 363: p. 164-184.
8. Langmuir, D., *Aqueous environmental geochemistry*. 1997.
9. Ewing, R. C., *Environmental impact of the nuclear fuel cycle*. Geological Society, London, Special Publications, 2004. 236(1): p. 7-23.
10. Bernier-Latmani, R., et al., *Non-uraninite products of microbial U (VI) reduction*. Environmental science & technology, 2010. 44(24): p. 9456-9462.
11. Brutinel, E. D. and J. A. Gralnick, *Shuttling happens: soluble flavin mediators of extracellular electron transfer in Shewanella*. Applied microbiology and biotechnology, 2012. 93(1): p. 41-48.
12. Lovley, D. R. and E. J. Phillips, *Microbial reduction of uranium*. Nature, 1991. 350(6317): p. 413.
13. Williams, K. H., et al., *Bioremediation of uranium-contaminated groundwater: a systems approach to subsurface biogeochemistry*. Current opinion in biotechnology, 2013. 24(3): p. 489-497.
14. Beazley, M. J., et al., *The effect of pH and natural microbial phosphatase activity on the speciation of uranium in subsurface soils*. Geochimica et Cosmochimica Acta, 2011. 75(19): p. 5648-5663.
15. Macaskie, L. E., et al., *Enzymically mediated bioprecipitation of uranium by a Citrobacter sp.: a concerted role for exocellular lipopolysaccharide and associated phosphatase in biomineral formation*. Microbiology, 2000. 146(8): p. 1855-1867.
16. Macaskie, L. E., et al., *Uranium Bioaccumulation by a Citrobacter sp. as a Result of Enzymically Mediated Growth of Polycrystalline $HUO_2PO_4$*. Science, 1992: p. 782-784.
17. Beveridge, T. and R. Murray, *Sites of metal deposition in the cell wall of Bacillus subtilis*. Journal of bacteriology, 1980. 141(2): p. 876-887.
18. Gadd, G. M., *Biosorption: critical review of scientific rationale, environmental importance and significance for pollution treatment*. Journal of Chemical Technology and Biotechnology, 2009. 84(1): p. 13-28.
19. Choudhary, S. and P. Sar, *Uranium biomineralization by a metal resistant Pseudomonas aeruginosa strain isolated from contaminated mine waste*. Journal of hazardous materials, 2011. 186(1): p. 336-343.
20. Ku, H. H., *Notes on the use of propagation of error formulas*. Journal of Research of the National Bureau of Standards—C. Engineering and Instrumentation, 1966. 70C(4): p. 263-273.
21. Bailey, T. L. and C. Elkan, *Fitting a mixture model by expectation maximization to discover motifs in biopolymers*. Proc Int Conf Intell Syst Mol Biol, 1994. 2: p. 28-36.
22. Zhou, B., et al., *The global regulatory architecture of transcription during the Caulobacter cell cycle*. PLoS Genet, 2015. 11(1): p. e1004831.
23. McGrath, P. T., et al., *High-throughput identification of transcription start sites, conserved promoter motifs and predicted regulons*. Nat Biotechnol, 2007. 25(5): p. 584-92.
24. Markich, S. J., *Uranium speciation and bioavailability in aquatic systems: an overview*. The Scientific World Journal, 2002. 2: p. 707-729.
25. Focazio, M. J., et al., *The Chemical Quality of Self-Supplied Domestic Well Water in the United States*. Groundwater Monitoring & Remediation, 2006. 26(3): p. 92-104.
26. Hoover, J., et al., *Elevated Arsenic and Uranium Concentrations in Unregulated Water Sources on the Navajo Nation, USA*. Exposure and Health, 2016: p. 1-12.
27. Kemp, R. S., *Environmental Detection of Clandestine Nuclear Weapon Programs*. Annual Review of Earth and Planetary Sciences, 2016. 44(1): p. 17-35.
28. Kemp, R. S., *Initial Analysis of the Detectability of $UO_2F_2$ Aerosols Produced by UF6 Released from Uranium Conversion Plants*. Science & Global Security, 2008. 16(3): p. 115-125.
29. Bostick, W., et al., *Sampling and characterization of aerosols formed in the atmospheric hydrolysis of $UF_6$*. 1983.
30. Wogman, N. A., *Prospects for the introduction of wide area monitoring using environmental sampling for proliferation detection*. Journal of Radioanalytical and Nuclear Chemistry, 2013. 296(2): p. 1071-1077.
31. Kips, R. S. and M. J. Kristo, *Investigation of chemical changes in uranium oxyfluoride particles using secondary ion mass spectrometry*. Journal of Radioanalytical and Nuclear Chemistry, 2009. 282(3): p. 1031.
32. Myers, W. L., *A literature review on the chemical and physical properties of uranyl fluoride ($UO_2F_2$)*. 1990: United States.
33. Langmuir, D., *Uranium solution-mineral equilibria at low temperatures with applications to sedimentary ore deposits*. Geochimica et Cosmochimica Acta, 1978. 42(6, Part A): p. 547-569.
34. Markich, S. J., *Uranium speciation and bioavailability in aquatic systems: an overview*. ScientificWorldJournal, 2002. 2: p. 707-29.
35. Sheng, L. and J. B. Fein, *Uranium adsorption by Shewanella oneidensis MR-1 as a function of dissolved inorganic carbon concentration*. Chemical Geology, 2013. 358: p. 15-22.
36. Bencheikh-Latmani, R. and J. O. Leckie, *Association of uranyl with the cell wall of Pseudomonas fluorescens*

*inhibits metabolism.* Geochimica et Cosmochimica Acta, 2003. 67(21): p. 4057-4066.
37. Nolan, J. and K. A. Weber, *Natural Uranium Contamination in Major U.S. Aquifers Linked to Nitrate.* Environmental Science & Technology Letters, 2015. 2(8): p. 215-220.
38. Ferla, M. P., et al., *New rRNA gene-based phylogenies of the Alphaproteobacteria provide perspective on major groups, mitochondrial ancestry and phylogenetic instability.* PLoS One, 2013. 8(12): p. e83383.
39. Slonczewski J L, F. J., *Microbiology: An Evolving Science* W. W. Norton & Company, 2014: p. 742-3.
40. Dworkin M, F. S., Rosenberg E, Schleifer K H, Stackebrandt E, *The Prokaryotes: Proteobacteria: Alpha and Beta Subclasses.* 2006. 5: p. 15-18.
41. Stock, A. M., V. L. Robinson, and P. N. Goudreau, *Two-component signal transduction.* Annual review of biochemistry, 2000. 69(1): p. 183-215.
42. Mascher, T., J. D. Helmann, and G. Unden, *Stimulus perception in bacterial signal-transducing histidine kinases.* Microbiology and Molecular Biology Reviews, 2006. 70(4): p. 910-938.
43. Capra, E. J. and M. T. Laub, *Evolution of two-component signal transduction systems.* Annual review of microbiology, 2012. 66: p. 325-347.
44. Sanders, D., et al., *Phosphorylation site of NtrC, a protein phosphatase whose covalent intermediate activates transcription.* Journal of bacteriology, 1992. 174 (15): p. 5117-5122.
45. Sanders, D. A., et al., *Identification of the site of phosphorylation of the chemotaxis response regulator protein, CheY.* Journal of Biological Chemistry, 1989. 264(36): p. 21770-21778.
46. Datsenko, K. A. and B. L. Wanner, *One-step inactivation of chromosomal genes in Escherichia coli K-12 using PCR products.* Proc Natl Acad Sci USA, 2000. 97(12): p. 6640-5.
47. Sharma, C. M., et al., *The primary transcriptome of the major human pathogen Helicobacter pylori.* Nature, 2010. 464(7286): p. 250.
48. Carey, M. F., C. L. Peterson, and S. T. Smale, *The primer extension assay.* Cold Spring Harbor Protocols, 2013. 2013(2): p. pdb. prot071902.
49. Wade, J. T., *Where to begin? Mapping transcription start sites genome-wide in Escherichia coli.* Journal of bacteriology, 2015. 197(1): p. 4-6.
50. Poindexter, J. S., *The caulobacters: ubiquitous unusual bacteria.* Microbiological reviews, 1981. 45(1): p. 123.
51. Hu, P., et al., *Whole-genome transcriptional analysis of heavy metal stresses in Caulobacter crescentus.* Journal of bacteriology, 2005. 187(24): p. 8437-8449.
52. Park, D. M. and Y. Jiao, *Modulation of medium pH by Caulobacter crescentus facilitates recovery from uranium-induced growth arrest.* Applied and environmental microbiology, 2014. 80(18): p. 5680-5688.
53. Bollmann, A., et al., *Isolation and physiology of bacteria from contaminated subsurface sediments.* Applied and environmental microbiology, 2010. 76(22): p. 7413-7419.
54. Yung, M. C. and Y. Jiao, *Biomineralization of uranium by PhoY phosphatase activity aids cell survival in Caulobacter crescentus.* Applied and environmental microbiology, 2014. 80(16): p. 4795-4804.
55. Hillson, N. J., et al., *Caulobacter crescentus as a whole-cell uranium biosensor.* Applied and environmental microbiology, 2007. 73(23): p. 7615-7621.
56. Cormack, B. P., R. H. Valdivia, and S. Falkow, *FACS-optimized mutants of the green fluorescent protein (GFP).* Gene, 1996. 173(1): p. 33-38.
57. Lovley, D. R. and E. Phillips, *Reduction of uranium by Desulfovibrio desulfuricans.* Applied and environmental microbiology, 1992. 58(3): p. 850-856.
58. Francis, A. J., et al., *XPS and XANES studies of uranium reduction by Clostridium sp.* Environmental science & technology, 1994. 28(4): p. 636-639.
59. Shelobolina, E. S., et al., *Isolation, characterization, and U (VI)-reducing potential of a facultatively anaerobic, acid-resistant Bacterium from Low-pH, nitrate-and U (VI)-contaminated subsurface sediment and description of Salmonella subterranea sp. nov.* Applied and Environmental Microbiology, 2004. 70(5): p. 2959-2965.
60. Wu, Q., R. A. Sanford, and F. E. Löffler, *Uranium (VI) reduction by Anaeromyxobacter dehalogenans strain 2CP-C.* Applied and environmental microbiology, 2006. 72(5): p. 3608-3614.
61. Begg, J. D., et al., *Bioreduction behavior of U (VI) sorbed to sediments.* Geomicrobiology Journal, 2011. 28(2): p. 160-171.
62. Istok, J., et al., *In situ bioreduction of technetium and uranium in a nitrate-contaminated aquifer.* Environmental Science & Technology, 2004. 38(2): p. 468-475.
63. Law, G. T., et al., *Uranium redox cycling in sediment and biomineral systems.* Geomicrobiology Journal, 2011. 28(5-6): p. 497-506.
64. Wilkins, M., et al., *The influence of microbial redox cycling on radionuclide mobility in the subsurface at a low-level radioactive waste storage site.* Geobiology, 2007. 5(3): p. 293-301.
65. Williams, K. H., et al., *Acetate availability and its influence on sustainable bioremediation of uranium-contaminated groundwater.* Geomicrobiology Journal, 2011. 28(5-6): p. 519-539.
66. Wu, W.-M., et al., *In situ bioreduction of uranium (VI) to submicromolar levels and reoxidation by dissolved oxygen.* Environmental Science & Technology, 2007. 41(16): p. 5716-5723.
67. Lovley, D. R., et al., *Geobacter metallireducens gen. nov. sp. nov., a microorganism capable of coupling the complete oxidation of organic compounds to the reduction of iron and other metals.* Archives of microbiology, 1993. 159(4): p. 336-344.
68. Richter, K., M. Schicklberger, and J. Gescher, *Dissimilatory reduction of extracellular electron acceptors in anaerobic respiration.* Applied and environmental microbiology, 2012. 78(4): p. 913-921.
69. Lovley, D. R., D. E. Holmes, and K. P. Nevin, *Dissimilatory fe (iii) and mn (iv) reduction.* Advances in microbial physiology, 2004. 49: p. 219-286.
70. Marsili, E., et al., *Shewanella secretes flavins that mediate extracellular electron transfer.* Proceedings of the National Academy of Sciences, 2008. 105(10): p. 3968-3973.
71. Suzuki, Y., et al., *Flavin mononucleotide mediated electron pathway for microbial U (VI) reduction.* Physical Chemistry Chemical Physics, 2010. 12(34): p. 10081-10087.
72. Von Canstein, H., et al., *Secretion of flavins by Shewanella species and their role in extracellular electron transfer.* Applied and environmental microbiology, 2008. 74(3): p. 615-623.
73. Anderson, R. T., et al., *Stimulating the in situ activity of Geobacter species to remove uranium from the ground-*

74. Senko, J. M., et al., *The effect of U (VI) bioreduction kinetics on subsequent reoxidation of biogenic U (IV)*. Geochimica et Cosmochimica Acta, 2007. 71(19): p. 4644-4654.
75. Martinez, R. J., et al., *Aerobic uranium (VI) bioprecipitation by metal-resistant bacteria isolated from radionuclide-and metal-contaminated subsurface soils*. Environmental microbiology, 2007. 9(12): p. 3122-3133.
76. Basnakova, G., et al., *The use of Escherichia coli bearing a phoN gene for the removal of uranium and nickel from aqueous flows*. Applied microbiology and biotechnology, 1998. 50(2): p. 266-272.
77. Powers, L. G., et al., *Introduction of a plasmid-encoded phoA gene for constitutive overproduction of alkaline phosphatase in three subsurface Pseudomonas isolates*. FEMS microbiology ecology, 2002. 41(2): p. 115-123.
78. Thomas, R. A. and L. Macaskie, *Biodegradation of tributyl phosphate by naturally occurring microbial isolates and coupling to the removal of uranium from aqueous solution*. Environmental science & technology, 1996. 30(7): p. 2371-2375.
79. Siuda, W. and R. Chróst, *Utilization of selected dissolved organic phosphorus compounds by bacteria in lake water under non-limiting orthophosphate conditions*. Polish Journal of Environmental Studies, 2001. 10(6): p. 475-484.
80. Lim, B. L., et al., *Distribution and diversity of phytate-mineralizing bacteria*. The ISME journal, 2007. 1(4): p. 321.
81. Ko, W.-h. and F. K. Hora, *Production of phospholipases by soil microorganisms*. Soil Science, 1970. 110(5): p. 355-358.
82. Kazy, S. K., S. F. D'Souza, and P. Sar, *Uranium and thorium sequestration by a Pseudomonas sp.: mechanism and chemical characterization*. J Hazard Mater, 2009. 163(1): p. 65-72.
83. Vanengelen, M. R., et al., *UO(2) 2+ speciation determines uranium toxicity and bioaccumulation in an environmental Pseudomonas sp. isolate*. Environ Toxicol Chem, 2010. 29(4): p. 763-9.
84. Choudhary, S. and P. Sar, *Uranium biomineralization by a metal resistant Pseudomonas aeruginosa strain isolated from contaminated mine waste*. J Hazard Mater, 2011. 186(1): p. 336-43.
85. Renninger, N., et al., *Uranyl precipitation by Pseudomonas aeruginosa via controlled polyphosphate metabolism*. Appl Environ Microbiol, 2004. 70(12): p. 7404-12.
86. Zhou, L., et al., *A protein engineered to bind uranyl selectively and with femtomolar affinity*. Nat Chem, 2014. 6(3): p. 236-41.
87. Pardoux, R., et al., *Modulating uranium binding affinity in engineered calmodulin EF-hand peptides: effect of phosphorylation*. PLoS One, 2012. 7(8): p. e41922.
88. Nomellini, J. F., et al., *S-layer-mediated display of the immunoglobulin G-binding domain of streptococcal protein G on the surface of Caulobacter crescentus: development of an immunoactive reagent*. Appl Environ Microbiol, 2007. 73(10): p. 3245-53.
89. Park, D. M., et al., *Bioadsorption of Rare Earth Elements through Cell Surface Display of Lanthanide Binding Tags*. Environ Sci Technol, 2016. 50(5): p. 2735-42.
90. Choppin, G., J. Liljenzin, and J. Rydberg, *Behavior of Radionuclides in the Environment*. Radiochemistry and Nuclear Chemistry, 1995.
91. Hsi, C.-k. D. and D. Langmuir, *Adsorption of uranyl onto ferric oxyhydroxides: application of the surface complexation site-binding model*. Geochimica et Cosmochimica Acta, 1985. 49(9): p. 1931-1941.
92. Koch-Steindl, H. and G. Prohl, *Considerations on the behaviour of long-lived radionuclides in the soil*. Radiation and environmental biophysics, 2001. 40(2): p. 93-104.
93. Davis, J. A., et al., *Approaches to surface complexation modeling of uranium (VI) adsorption on aquifer sediments*. Geochimica et Cosmochimica Acta, 2004. 68(18): p. 3621-3641.
94. Pabalan, R. T., et al., *Uranium (VI) sorption onto selected mineral surfaces: Key geochemical parameters*. 1996, American Chemical Society, Washington, DC (United States).
95. Siegel, M. and C. Bryan, *Radioactive Contamination*. Environmental Geochemistry, 2005. 9: p. 205.
96. Bargar, J. R., et al., *Uranium redox transition pathways in acetate-amended sediments*. Proceedings of the National Academy of Sciences, 2013. 110(12): p. 4506-4511.
97. Utturkar, S. M., et al., *Draft genome sequence for Caulobacter sp. strain OR37, a bacterium tolerant to heavy metals*. Genome announcements, 2013. 1(3): p. e00322-13.
98. Garst, A. D., A. L. Edwards, and R. T. Batey, *Riboswitches: structures and mechanisms*. Cold Spring Harb Perspect Biol, 2011. 3(6).
99. Breaker, R. R., *Riboswitches and the RNA world*. Cold Spring Harb Perspect Biol, 2012. 4(2).
100. Hallberg, Z. F., et al., *Engineering and In Vivo Applications of Riboswitches*. Annu Rev Biochem, 2017. 86: p. 515-539.
101. !!! INVALID CITATION !!! [101].
102. Baker, J. L., et al., *Widespread genetic switches and toxicity resistance proteins for fluoride*. Science, 2012. 335(6065): p. 233-235.
103. Breaker, R. R., *New insight on the response of bacteria to fluoride*. Caries Res, 2012. 46(1): p. 78-81.
104. Ren, A., K. R. Rajashankar, and D. J. Patel, *Fluoride ion encapsulation by Mg2+ ions and phosphates in a fluoride riboswitch*. Nature, 2012. 486(7401): p. 85-9.
105. Stockbridge, R. B., et al., *Fluoride resistance and transport by riboswitch-controlled CLC antiporters*. Proc Natl Acad Sci USA, 2012. 109(38): p. 15289-94.
106. Zhao, B., et al., *An excited state underlies gene regulation of a transcriptional riboswitch*. Nat Chem Biol, 2017. 13(9): p. 968-974.
107. Park, D. M. and M. J. Taffet, *Combinatorial Sensor Design in Caulobacter crescentus for Selective Environmental Uranium Detection*. ACS Synth Biol, 2019. 8(4): p. 807-817.
108. Weinberg, Z., et al., *Comparative genomics reveals 104 candidate structured RNAs from bacteria, archaea, and their metagenomes*. Genome Biol, 2010. 11(3): p. R31.
109. Finn, R. D., et al., *The Pfam protein families database: towards a more sustainable future*. Nucleic Acids Res, 2016. 44(D1): p. D279-85.
110. Brewster, R. C., et al., *The transcription factor titration effect dictates level of gene expression*. Cell, 2014. 156(6): p. 1312-23.
111. Shin, J. and V. Noireaux, *An E. coli cell-free expression toolbox: application to synthetic gene circuits and artificial cells*. ACS Synth Biol, 2012. 1(1): p. 29-41.

112. Procaccini, A., et al., *Dissecting the specificity of protein-protein interaction in bacterial two-component signaling: orphans and crosstalks.* PloS one, 2011. 6(5): p. e19729.
113. Folliard, T., et al., *Ribo-attenuators: novel elements for reliable and modular riboswitch engineering.* Sci Rep, 2017. 7(1): p. 4599.
114. Buttner, D. and U. Bonas, *Who comes first? How plant pathogenic bacteria orchestrate type III secretion.* Current opinion in microbiology, 2006. 9(2): p. 193-200.
115. Hutcheson, S. W., et al., *Enhancer-Binding Proteins HrpR and HrpS Interact To Regulate hrp-Encoded Type III Protein Secretion in Pseudomonas syringae Strains.* Journal of Bacteriology, 2001. 183(19): p. 5589-5598.
116. Jin, Q., et al., *Type III protein secretion in Pseudomonas syringae.* Microbes and Infection, 2003. 5(4): p. 301-310.
117. Dove, S. L. and A. Hochschild, *Conversion of the ω subunit of Escherichia coli RNA polymerase into a transcriptional activator or an activation target.* Genes & development, 1998. 12(5): p. 745-754.
118. Blondel, A. and H. Bedouelle, *Engineering the quaternary structure of an exported protein with a leucine zipper.* Protein Eng, 1991. 4(4): p. 457-61.
119. Cheng, P.-C., *The contrast formation in optical microscopy*, in *Handbook of Biological Confocal Microscopy.* 2006, Springer. p. 162-206.
120. Helms, V., *Principles of computational cell biology.* 2008: John Wiley & Sons.
121. Zheng, J., *Spectroscopy-based quantitative fluorescence resonance energy transfer analysis.* Ion channels: methods and protocols, 2006: p. 65-77.
122. Periasamy, A., *Fluorescence resonance energy transfer microscopy: a mini review.* Journal of biomedical optics, 2001. 6(3): p. 287-291.
123. Nguyen, A. W. and P. S. Daugherty, *Evolutionary optimization of fluorescent proteins for intracellular FRET.* Nature biotechnology, 2005. 23(3): p. 355.
124. Buchler, N. E., U. Gerland, and T. Hwa, *On schemes of combinatorial transcription logic.* Proceedings of the National Academy of Sciences, 2003. 100(9): p. 5136-5141.
125. Silva-Rocha, R. and V. de Lorenzo, *Mining logic gates in prokaryotic transcriptional regulation networks.* FEBS letters, 2008. 582(8): p. 1237-1244.
126. Wang, B., et al., *Engineering modular and orthogonal genetic logic gates for robust digital-like synthetic biology.* Nature communications, 2011. 2: p. 508.
127. Park, M., S. L. Tsai, and W. Chen, *Microbial biosensors: engineered microorganisms as the sensing machinery.* Sensors (Basel), 2013. 13(5): p. 5777-95.
128. Yagi, K., *Applications of whole-cell bacterial sensors in biotechnology and environmental science.* Appl Microbiol Biotechnol, 2007. 73(6): p. 1251-8.
129. Dai, C. and S. Choi, *Technology and Applications of Microbial Biosensor.* Open Journal of Applied Biosensor, 2013. 2(3).
130. Bereza-Malcolm, L. T., G. Mann, and A. E. Franks, *Environmental Sensing of Heavy Metals Through Whole Cell Microbial Biosensors: A Synthetic Biology Approach.* ACS Synth Biol, 2014.
131. Hwang, I. Y., et al., *Engineered probiotic Escherichia coli can eliminate and prevent Pseudomonas aeruginosa gut infection in animal models.* Nature Communications, 2017. 8: p. 15028.
132. King, J. M., et al., *Rapid, sensitive bioluminescent reporter technology for naphthalene exposure and biodegradation.* Science, 1990. 249(4970): p. 778-81.
133. Belkin, S., et al., *Remote detection of buried landmines using a bacterial sensor.* Nat Biotechnol, 2017. 35(4): p. 308-310.
134. Kabessa, Y., et al., *Standoff detection of explosives and buried landmines using fluorescent bacterial sensor cells.* Biosensors and Bioelectronics, 2016. 79: p. 784-788.
135. Wang, B., M. Barahona, and M. Buck, *Engineering modular and tunable genetic amplifiers for scaling transcriptional signals in cascaded gene networks.* Nucleic Acids Res, 2014. 42(14): p. 9484-92.
136. Berset, Y., et al., *Mechanistic Modeling of Genetic Circuits for ArsR Arsenic Regulation.* ACS Synth Biol, 2017. 6(5): p. 862-874.
137. Buffi, N., et al., *An automated microreactor for semicontinuous biosensor measurements.* Lab Chip, 2016. 16(8): p. 1383-92.
138. Truffer, F., et al., *Compact portable biosensor for arsenic detection in aqueous samples with Escherichia coli bioreporter cells.* Rev Sci Instrum, 2014. 85(1): p. 015120.
139. Sambrook, J., E. Fritsch, and T. Maniatis, *Molecular cloning: a laboratory manual, 2nd edn.* Cold Spring Laboratory Press. New York, 1989.
140. Innis, M. A., D. H. Gelfand, and J. J. Sninsky, *PCR strategies.* 1995: Academic Press.
141. Myers, E. W. and W. Miller, *Optimal alignments in linear space.* Computer applications in the biosciences: CABIOS, 1988. 4(1): p. 11-17.
142. Smith, T. F. and M. S. Waterman, *Comparison of biosequences.* Advances in applied mathematics, 1981. 2(4): p. 482-489.
143. Needleman, S. B. and C. D. Wunsch, *A general method applicable to the search for similarities in the amino acid sequence of two proteins.* Journal of molecular biology, 1970. 48(3): p. 443-453.
144. Pearson, W. R. and D. J. Lipman, *Improved tools for biological sequence comparison.* Proceedings of the National Academy of Sciences, 1988. 85(8): p. 2444-2448.
145. Karlin, S. and S. F. Altschul, *Methods for assessing the statistical significance of molecular sequence features by using general scoring schemes.* Proceedings of the National Academy of Sciences, 1990. 87(6): p. 2264-2268.
146. Karlin, S. and S. F. Altschul, *Applications and statistics for multiple high-scoring segments in molecular sequences.* Proceedings of the National Academy of Sciences, 1993. 90(12): p. 5873-5877.
147. Stephens, C., et al., *A cell cycle-regulated bacterial DNA methyltransferase is essential for viability.* Proceedings of the National Academy of Sciences, 1996. 93(3): p. 1210-1214.
148. Hierlemann, A. and H. Baltes, *CMOS-based chemical microsensors.* Analyst, 2003. 128(1): p. 15-28.
149. Evinger, M. and N. Agabian, *Envelope-associated nucleoid from Caulobacter crescentus stalked and swarmer cells.* J Bacteriol, 1977. 132(1): p. 294-301.
150. Arellano, B. H., et al., *Identification of a dehydrogenase required for lactose metabolism in Caulobacter crescentus.* Appl Environ Microbiol, 2010. 76(9): p. 3004-14.
151. Skerker, J. M., et al., *Two-component signal transduction pathways regulating growth and cell cycle progression in a bacterium: a system-level analysis.* PLoS Biol, 2005. 3(10): p. e334.
152. Christen, B., et al., *High-throughput identification of protein localization dependency networks.* Proc Natl Acad Sci USA, 2010. 107(10): p. 4681-6.

153. Park, D. M., et al., *Identification of a U/Zn/Cu responsive global regulatory two-component system in Caulobacter crescentus*. Mol Microbiol, 2016.
154. Stephens, C., et al., *A cell cycle-regulated bacterial DNA methyltransferase is essential for viability*. Proc Natl Acad Sci USA, 1996. 93(3): p. 1210-4.
155. Fiebig, A., et al., *Interaction specificity, toxicity and regulation of a paralogous set of ParE/RelE-family toxin-antitoxin systems*. Mol Microbiol, 2010. 77(1): p. 236-51.
156. Goodrich, R., Lorega, G., *LLNL Livermore Site and Site 300 Environmental Restoration Project Standard Operating Procedures (SOPs)*. Lawrence Livermore National Laboratory Livermore, Calif, 2016. (UCRL-MA-109115 Rev. 15).
157. Arellano, B. H., et al., *Identification of a dehydrogenase required for lactose metabolism in Caulobacter crescentus*. Applied and environmental microbiology, 2010. 76(9): p. 3004-3014.
158. Fiebig, A., et al., *Interaction specificity, toxicity and regulation of a paralogous set of ParE/Re/E-family toxin-antitoxin systems*. Molecular microbiology, 2010. 77(1): p. 236-251.
159. Andersen, J. B., et al., *New unstable variants of green fluorescent protein for studies of transient gene expression in bacteria*. Appl Environ Microbiol, 1998. 64(6): p. 2240-6.
160. Hu, P., et al., *Whole-genome transcriptional analysis of heavy metal stresses in Caulobacter crescentus*. J Bacteriol, 2005. 187(24): p. 8437-49.
161. Park, D. M. and Y. Jiao, *Modulation of medium pH by Caulobacter crescentus facilitates recovery from uranium-induced growth arrest*. Appl Environ Microbiol, 2014. 80(18): p. 5680-8.
162. Yung, M. C., et al., *Shotgun proteomic analysis unveils survival and detoxification strategies by Caulobacter crescentus during exposure to uranium, chromium, and cadmium*. J Proteome Res, 2014. 13(4): p. 1833-47.
163. Hillson, N. J., et al., *Caulobacter crescentus as a whole-cell uranium biosensor*. Appl Environ Microbiol, 2007. 73(23): p. 7615-21.
164. Cabantous, S., et al., *A new protein-protein interaction sensor based on tripartite split-GFP association*. Sci Rep, 2013. 3: p. 2854.
165. Britos, L., et al., *Regulatory response to carbon starvation in Caulobacter crescentus*. PLoS One, 2011. 6(4): p. e18179.
166. Jonas, K., et al., *Proteotoxic stress induces a cell-cycle arrest by stimulating Lon to degrade the replication initiator DnaA*. Cell, 2013. 154(3): p. 623-36.
167. Modell, J. W., A. C. Hopkins, and M. T. Laub, *A DNA damage checkpoint in Caulobacter crescentus inhibits cell division through a direct interaction with FtsW*. Genes Dev, 2011. 25(12): p. 1328-43.
168. da Silva Neto, J. F., R. F. Lourenco, and M. V. Marques, *Global transcriptional response of Caulobacter crescentus to iron availability*. BMC Genomics, 2013. 14: p. 549.
169. Blanco, A. G., et al., *Tandem DNA Recognition by PhoB, a Two-Component Signal Transduction Transcriptional Activator*. Structure, 2002. 10(5): p. 701-713.
170. Park, D. M. and P. J. Kiley, *The influence of repressor DNA binding site architecture on transcriptional control*. MBio, 2014. 5(5): p. e01684-14.
171. Nriagu, J. O., *Lead orthophosphates. I. Solubility and hydrolysis of secondary lead orthophosphate*. Inorganic Chemistry, 1972. 11(10): p. 2499-2503.
172. Tripet, B., et al., *Engineering a de novo designed coiled-coil heterodimerization domain for the rapid detection, purification and characterization of recombinantly expressed peptides and proteins*. Protein Eng, 1997. 10(3): p. 299.
173. Yung, M. C. and Y. Jiao, *Biomineralization of uranium by PhoY phosphatase activity aids cell survival in Caulobacter crescentus*. Appl Environ Microbiol, 2014. 80(16): p. 4795-804.
174. Roggo, C. and J. R. van der Meer, *Miniaturized and integrated whole cell living bacterial sensors infield applicable autonomous devices*. Curr Opin Biotechnol, 2017. 45: p. 24-33.
175. Park, D. M., et al., *Identification of a U/Zn/Cu responsive global regulatory two-component system in Caulobacter crescentus*. Mol Microbiol, 2017. 104(1): p. 46-64.
176. Weinstein, L. H. and A. Davison, *Fluorides in the Environment: Effect on Plants and Animals*. 2004.
177. Stockbridge, R. B., et al., *A family of fluoride-specific ion channels with dual-topology architecture*. Elife, 2013. 2: p. e01084.
178. Malakooti, J., S. P. Wang, and B. Ely, *A consensus promoter sequence for Caulobacter crescentus genes involved in biosynthetic and housekeeping functions*. J Bacteriol, 1995. 177(15): p. 4372-6.

SEQUENCE LISTING (2527 sequences)

SEQ ID NO: 1 - DNA, 18 bp, Artificial sequence
  Synthetic polynucleotide
  misc_feature (1)..(1): N1 is C or T, preferably C
  misc_feature (1)..(1): N is C or T, preferably C
  misc_feature (2)..(2): N2 is G or A, preferably G
  misc_feature (3)..(3): N3 is T or C, preferably T
  misc_feature (4)..(4): N4 is C
  misc_feature (5)..(5): N5 is A or G, preferably A
  misc_feature (6)..(6): N6 is G or C, preferably G
  misc_feature (7)..(7): N7 C or G
  misc_feature (8)..(8): N8 is any nucleotide
  misc_feature (9)..(9): N9 is any nucleotide
  misc_feature (10)..(10): N10 is any nucleotide
  misc_feature (11)..(11): N11 is any nucleotide
  misc_feature (12)..(12): N12 is T or C
  misc_feature (13)..(13): N13 is G
  misc_feature (14)..(14): N14 is T or C, preferably T
  misc_feature (15)..(15): N15 is C
  misc_feature (16)..(16): N16 is A or C, preferably A
  misc_feature (17)..(17): N17 is G
  misc_feature (18)..(18): N18 is C or G
nnnnnnnnnnnnnnnnnn

SEQ ID NO: 2 - DNA, 16 bp, Artificial sequence
  Synthetic polynucleotide
  misc_feature (7)..(12): wherein N7-N12 is independently any nucleotide
  misc_feature (7)..(11): in some embodiments any one of N7-N11 can independently be A
  misc_feature (7)..(12): in an embodiment, each of N7-N12 can be A
cattacnnnnnnttaa

SEQ ID NO: 3 - protein, 452 aa, C. crescentus NA1000
MSGGSLRWRLIVGGMLAILAALAVAWLAMTWLFERHIVRRETADLTRAGQVLVAGLRLEPNGAPVIDATLSDPRLSKAAGGFYWQVSTTSGSERSVSLWDQALKPPQTAPAEGWSSRIAAGPFDDRVLLVERSVRPDRDGPAVLIQVASDEKVLRAARREFGRELAIFLGGLWAILSGAAALQVVLGLSPLTRVRADLARLRKSPSARMSLDHPREIAPLAEAINALAEAREADLARARRRAGDLAHSLKTPLAALSAQSRRAREDGAVAAADGLDAAIASVAAALEAELARARAAAAREAVFAAETAPLAVAERLVAVLERTADGERLIFDIDVPADLKAPASEDVVTEMLGALIENAARHARRQVRISGAVVGQGAVLIVEDDGPGLDKGRAEAALARGARLDEAGPGHGLGLAIVRDLAEASGAVLSMDRGDLGGLRAMVSWTAPGAGP

SEQ ID NO: 4 - protein, 222 aa, C. crescentus NA1000
MMRALVVEDDPVVGPDLAKALSASGFVVDIARDGEDASFKGEVEDYALVVLDLGLPRLDGLSVLRRWRANDRAFPVLILSARGDWTEKVEGIEAGADDYLAKPFEMGELLARARGLVRRAAGRTSPVIGAGRLALDTRRMSATLDGAPIRLSPLEFRLLDCLAHNPGRAVSAGELAEQLYGVADTADTNAIEALVARLRRKIGADVIETRRGFGYLLAGGTA

SEQ ID NO: 5 - protein, 468 aa, C. crescentus NA1000
MRLPRLLRTTPFRLTLLFLALFAAAASAFLGYIYVATAGEVNRRAQAEISREFESLEAAYRQGGVDALNQTIVERATSERPFLYFLADKDGKRISGSIEESPVSGFTGDGPEWASFKVTETDLDGAEVKAAARGVQQRLDNGEILFVGADVDASEAYVRKIVRALWGAGALVILLGMAGGVLISRNVSRSMQGLVDVVNAVRGGDLHARARVRGTRDEYDELAEGLNDMLDRIERLMGGLRHAGDAIAHDLRSPLTRLRARMEVALIDAENGKGDPVAALETALQDADGVLKTFNAVLAIARLQAAGSAPDQRQFDASELAGDMAELYELSCEDKGLDFKAEIVPALTIKGNREFLAQALANILDNAIKYTPEGGAIMLRARRTSSGELEFSVTDTGPGVPEADRARVVQRFVRLENSRSEPGAGLGLSLVSAVATSHGGRLELAEGPGEYNGMGPGLRVALVLPRVE

SEQ ID NO: 6 - protein, 223 aa, Caulobacter crescentus NA1000
MRILIIEDDLEAAGAMAHGLKEAGYDVAHAPDGEAGLAEAQKGGWDVLVVDRMMPKMDGVTVVETLRREGDQTPVLFLSALGEVNDRVVGLKAGADDYLVKPYAFPELMARVEALSRRRETGAVATTLKVGELEMNLINRTVHRQGKEIDLQPREFQLLEFMMRHAGQSVTRTMLLEKVWEYHFDPQTNVIDVHISRLRSKIDKGFDRAMLQTVRGAGYRLDP

SEQ ID NO: 7 - DNA, 18 bp, Artificial sequence
  Synthetic polynucleotide
  misc_feature (1)..(18): N can be any nucleotide
cgtcagcnnnntgtcagc

SEQ ID NO: 8 - DNA, 18 bp, Artificial sequence
  Synthetic polynucleotide
  misc_feature (1)..(18): N can be any nucleotide
cgtcaggnnnntgtcagg

SEQ ID NO: 9 - DNA, 18 bp, Artificial sequence
  Synthetic polynucleotide
  misc_feature (1)..(18): N can be any nucleotide
cgtcagcnnnntgtcagg

SEQ ID NO: 10 - DNA, 18 bp, Artificial sequence
  Synthetic polynucleotide
  misc_feature (1)..(18): N can be any nucleotide
cgtcagcnnnncgtcagg

SEQ ID NO: 11 - DNA, 18 bp, Artificial sequence
  Synthetic polynucleotide
  misc_feature (1)..(18): N can be any nucleotide
tgtcagcnnnntgtcagc

SEQ ID NO: 12 - DNA, 18 bp, Artificial sequence
  Synthetic polynucleotide
  misc_feature (1)..(18): N can be any nucleotide
cgcctgcnnnncgtcagc

SEQ ID NO: 13 - DNA, 18 bp, Artificial sequence
  Synthetic polynucleotide
  misc_feature (1)..(18): N can be any nucleotide
cgtcaggnnnncgtcagc

SEQ ID NO: 14 - DNA, 18 bp, Artificial sequence
  Synthetic polynucleotide
  misc_feature (1)..(18): N can be any nucleotide
cgtcagcnnnntgtcagc

SEQ ID NO: 15 - DNA, 18 bp, Artificial sequence
  Synthetic polynucleotide
  misc_feature (1)..(18): N can be any nucleotide
tgtcaggnnnntgtcagc

SEQ ID NO: 16 - DNA, 18 bp, Artificial sequence
  Synthetic polynucleotide
  misc_feature (1)..(18): N can be any nucleotide
cgtcagcnnnncgtcagt

SEQ ID NO: 17 - DNA, 18 bp, Artificial sequence
  Synthetic polynucleotide
  misc_feature (1)..(18): N can be any nucleotide
ccgcgggnnnntgtcagg

SEQ ID NO: 18 - DNA, 18 bp, Artificial sequence
  Synthetic polynucleotide
  misc_feature (1)..(18): N can be any nucleotide
cgtcgggnnnnagaccgg

SEQ ID NO: 19 - DNA, 18 bp, Artificial sequence
  Synthetic polynucleotide
  misc_feature (1)..(18): N can be any nucleotide
cgtccggnnnncgtcaga

SEQ ID NO: 20 - DNA, 18 bp, Artificial sequence
  Synthetic polynucleotide
  misc_feature (1)..(18): N can be any nucleotide
caacgccnnnncgtcagc

SEQ ID NO: 21 - DNA, 18 bp, Artificial sequence
  Synthetic polynucleotide
  misc_feature (1)..(18): N can be any nucleotide
catcaggnnnncgtcagc

SEQ ID NO: 22 - DNA, 18 bp, Artificial sequence
  Synthetic polynucleotide
  misc_feature (1)..(18): N can be any nucleotide
cgcagggnnnntgcaagc

SEQ ID NO: 23 - DNA, 18 bp, Artificial sequence
  Synthetic polynucleotide
  misc_feature (1)..(18): N can be any nucleotide
catcagcnnnncgtcagc

SEQ ID NO: 24 - DNA, 18 bp, Artificial sequence
  Synthetic polynucleotide
  misc_feature (1)..(18): N can be any nucleotide
cgtcatcnnnntgtcacg

SEQ ID NO: 25 - DNA, 18 bp, Artificial sequence
  Synthetic polynucleotide
  misc_feature (1)..(18): N can be any nucleotide
cgtcagcnnnncatcagc

SEQ ID NO: 26 - DNA, 18 bp, Artificial sequence
  Synthetic polynucleotide
  misc_feature (1)..(18): N can be any nucleotide
cttcgcgnnnncgtccgg

SEQ ID NO: 27 - DNA, 18 bp, Artificial sequence
  Synthetic polynucleotide
  misc_feature (1)..(18): N can be any nucleotide
cgtcaggnnnnggtcagg

SEQ ID NO: 28 - DNA, 18 bp, Artificial sequence
  Synthetic polynucleotide
  misc_feature (1)..(18): N can be any nucleotide
tgtcagcnnnnatcctgc

SEQ ID NO: 29 - DNA, 6 bp, Artificial sequence
  Synthetic polynucleotide
cattac

SEQ ID NO: 30 - DNA, 6 bp, Artificial sequence
  Synthetic polynucleotide
caatag

SEQ ID NO: 31 - DNA, 4 bp, Artificial sequence
  Synthetic polynucleotide
ttaa

SEQ ID NO: 32 - DNA, 4 bp, Artificial sequence
  Synthetic polynucleotide
taat

SEQ ID NO: 33 - protein, 150 aa, Caulobacter Crescentus N100
MTRDQDTLRMLAEVEAANADLARRAKAPLWYHPALGLLVGALIAVQGQPTSILLVFYAAYIAGLALLVRAYKRHTGLWVSGYRAGRTRWVALGLATLTMIGGVIAVWLLRERGLTAAPLIFGAIVAVIVTVGGFVWEAAFRADLRDGRPL

SEQ ID NO: 34 - protein, 412 aa, Caulobacter Crescentus N100
MRRGSQPMHAPISATERSTIAQIGGRNAPIGALRAFVTLLVIAHHTVLAYTPNPPPIGDFSQAPYLWQAFPVRDPQKFELFGLLTLINDLFFMSLMFFISGLFVADGLRAKGNGGLLSGRAARLGVPFVLAAGLLAPLAYFPAWLQAGGDVSIAGFASAWLDLPSWPSGPAWFLWVLLAFGAIVTLLNLIAPGVIDALGRLVRGADRKPGLFFLGLVIASAVAYIPMSATFTFMHWTQLGPFTVQTSRVVHYFVYFLAGVAVGAAGVGQGLTDSEGKLAKRWWAWQAAPILPVVGVIAVIIMAFSPKPPPRVALDIGGGVMFALACATLSFAALATFLRFVKKTGPVAASLQANAYGMYLTHYVFTTWLAWLLLPQAWGGLAKGAAVFVGATLLSWILTMALRRLPLLGRIL

SEQ ID NO: 35 - protein, 98 aa, Caulobacter crescentus NA1000
MSAALDPVIHAPNRLQMCCMLAAVDTIDFATVREALDVSESVLSKHVKTLEEAGYVKVKKAASDGRQRTWLSLSKPGREALKGHLAALKAMMAGVPEA

SEQ ID NO: 36 - protein, 103 aa, Caulobacter crescentus NA1000
MAPRFDISGLDDVIHGRVRLGIVAYLASAEVADFTELKDVLEVTQGNLSIHLRKLEEAGYVSIDKSFVGRKPLTRVRLTDTGRAAFSSYLRAMGQLVEQAGGG

SEQ ID NO: 37 - DNA, 34 bp, Artificial sequence
  Synthetic polynucleotide
taaccctttgcaaaccggacggtgaccggcaaac

SEQ ID NO: 38 - DNA, 34 bp, Artificial sequence
  Synthetic polynucleotide
gatgaacttgcgcatggcggagcccctcgttttc

SEQ ID NO: 39 - DNA, 34 bp, Artificial sequence
  Synthetic polynucleotide
taaccctttgcaaacgaacgatagcgccgcctgc

SEQ ID NO: 40 - DNA, 56 bp, Artificial sequence
  Synthetic polynucleotide
tccctctggctgggcggaaagatcgggactgggtgatggcgcttaggattccacag

SEQ ID NO: 41 - DNA, 22 bp, Artificial sequence
  Synthetic polynucleotide
atgcgcaagttcatcatgagcc

SEQ ID NO: 42 - DNA, 24 bp, Artificial sequence
  Synthetic polynucleotide
gtttgcaaagggttaatcgacgcc

SEQ ID NO: 43 - DNA, 32 bp, Artificial sequence
  Synthetic polynucleotide
ggaacgatagcgccggacggtgaccggcaaac

SEQ ID NO: 44 - DNA, 23 bp, Artificial sequence
  Synthetic polynucleotide
cgcacaaaatcctcatcctgagc

SEQ ID NO: 45 - DNA, 34 bp, Artificial sequence
  Synthetic polynucleotide
caattgaagccggctcagaaggtcgacgccctgg

SEQ ID NO: 46 - DNA, 23 bp, Artificial sequence
  Synthetic polynucleotide
cgcacaaaatcctcatcctgagc

SEQ ID NO: 47 - DNA, 32 bp, Artificial sequence; identical to SEQ ID NO: 43
  Synthetic polynucleotide

SEQ ID NO: 48 - DNA, 29 bp, Artificial sequence
  Synthetic polynucleotide
aatcagaatgcgcatggcggagcccctcg

SEQ ID NO: 49 - DNA, 25 bp, Artificial sequence
  Synthetic polynucleotide
atgcgcattctgattatcgaggacg

SEQ ID NO: 50 - DNA, 20 bp, Artificial sequence
  Synthetic polynucleotide
cggcgctatcgttccctagg

SEQ ID NO: 51 - DNA, 35 bp, Artificial sequence
  Synthetic polynucleotide
gtgaaaaaagcttaactcgaggggctccgccatgc

SEQ ID NO: 52 - DNA, 39 bp, Artificial sequence
  Synthetic polynucleotide
ttaagcttttttcacgcagtctcgcagctagcttagccg

SEQ ID NO: 53 - DNA, 44 bp, Artificial sequence
  Synthetic polynucleotide
gtgaaaaaagcttaactccgagctccctaactaactaatcatct

SEQ ID NO: 54 - DNA, 42 bp, Artificial sequence
  Synthetic polynucleotide
ttaagcttttttcacgcagtgatggcgcttaggattccacag

SEQ ID NO: 55 - DNA, 36 bp, Artificial sequence
  Synthetic polynucleotide
tggggagacgaccatatgcgtaagggcgaagagctg

SEQ ID NO: 56 - DNA, 37 bp, Artificial sequence
  Synthetic polynucleotide
cacggctggctgcaggccgaatttcaggggtacagca

SEQ ID NO: 57 - DNA, 28 bp, Artificial sequence
  Synthetic polynucleotide
gatcccggggatttctcttcgcgccacc

SEQ ID NO: 58 - DNA, 28 bp, Artificial sequence
  Synthetic polynucleotide
gaaatccccgggatccctgtgctctaga

SEQ ID NO: 59 - DNA, 27 bp, Artificial sequence
  Synthetic polynucleotide
gactctagacgaagactgggcgggcag

SEQ ID NO: 60 - DNA, 29 bp, Artificial sequence
  Synthetic polynucleotide
gacagatctcggtttgggtggtcgcttgg

SEQ ID NO: 61 - DNA, 29 bp, Artificial sequence
  Synthetic polynucleotide
ttgtcgacgtatgacgtttgctctatagc

SEQ ID NO: 62 - DNA, 22 bp, Artificial sequence
  Synthetic polynucleotide
cgttcacatcgccatccagctc

SEQ ID NO: 63 - DNA, 23 bp, Artificial sequence
  Synthetic polynucleotide
atggcgatgtgaacggccataag

SEQ ID NO: 64 - DNA, 37 bp, Artificial sequence
  Synthetic polynucleotide
gtcatacgtcgacaagccgaatttcaggggtacagca

SEQ ID NO: 65 - DNA, 42 bp, Artificial sequence
  Synthetic polynucleotide
atgtttttcctccttataaagtagatctttagttagttaggg

SEQ ID NO: 66 - DNA, 36 bp, Artificial sequence
  Synthetic polynucleotide
aaggaggaaaaacatatgcgtaagggcgaagagctg

SEQ ID NO: 67 - DNA, 37 bp, Artificial sequence
  Synthetic polynucleotide
gaaatccccgggatcgccgaatttcaggggtacagca

SEQ ID NO: 68 - DNA, 24 bp, Artificial sequence
  Synthetic polynucleotide
ggtcgctaccattaccagttggtc

SEQ ID NO: 69 - DNA, 25 bp, Artificial sequence
  Synthetic polynucleotide
tgcttgggtcgtttgagtatatggt

SEQ ID NO: 70 - DNA, 35 bp, Artificial sequence
  Synthetic polynucleotide
caaacgacccaagcaggtgtcgcccttcgctgaac

SEQ ID NO: 71 - DNA, 41 bp, Artificial sequence
  Synthetic polynucleotide
gtaatggtagcgaccccaagctcagctaattaagcctcgag

SEQ ID NO: 72 - DNA, 37 bp, Artificial sequence; identical to SEQ ID NO: 67
  Synthetic polynucleotide

SEQ ID NO: 73 - DNA, 39 bp, Artificial sequence
  Synthetic polynucleotide
ggctggcgccaagcttggccggccgcacgcaagggcaga

SEQ ID NO: 74 - DNA, 25 bp, Artificial sequence
  Synthetic polynucleotide
ttatttttgacaccagaccaactgg

SEQ ID NO: 75 - DNA, 31 bp, Artificial sequence
  Synthetic polynucleotide
tggtgtcaaaaataatcgcacaggcgaccgc

SEQ ID NO: 76 - DNA, 34 bp, Artificial sequence
  Synthetic polynucleotide
gcgaattcgtggatccaggcgtcgaggtgaagta

SEQ ID NO: 77 - DNA, 190 bp, Artificial sequence
  Synthetic polynucleotide
gaacgatagcgccgcctgcgagcgcgacctcaggcctcggacgaagcgcgtccggggccttttcttgtcgatgttcagcgcctggttaccggcgatggcgcggtgtcagcgttcgggcgttgcgatgcgtcaggagcgtgtcaggatgcctgtggaatcctaagcgccatcacccagtcccgatctttcc

SEQ ID NO: 78 - DNA, 246 bp, Artificial sequence
  Synthetic polynucleotide
ccggacggtgaccggcaaaccaccgctgtcatgaatgcgttttgaagcttcgccataacgcgccttgggtatccggttcggaacgcggcgctttcgttgacctctggccacggagaattctccatcccaaagagggtgtggcccaaagagggtgtggatttctcttcgcgccacccgtttcgtcagccggacgtcaggtccagacggctaagctagctgcgagacatgaaaacgaggggctccgcc

SEQ ID NO: 79 - DNA, 555 bp, Artificial sequence
  Synthetic polynucleotide
tgaggattttgtgcgccaggcatcaaataaaacgaaaggctcagtcgaaagactgggcctttcgttttatctgttgtttgtcggtgaacgctctctactagagtcacactggctcaccttcgggtgggcctttctgcgtttatacctagggaacgatagcgccgcctgcgagcgcgacctcaggcctcggacgaagcgcgtccggggccttttcttgtcgatgttcagcgcctggttaccggcgatggcgcggtgtcagcgttcgggcgttgcgatgcgtcaggagcgtgtcaggatgcctgtggaatcctaagcgccatcacccagtcccgatctttccgagctccctaactaactaatcatctactttataaggaggaaaaacatatgcgcattctgattatcgaggacgacctggaagccgccggcgccatggcgcacgggctcaaggaagccggctacgacgtcgcccacgcgccggacggcgaggcgggcctggccgaggcccagaagggcggctgggacgtgctggtcgtcgcccggatgatgcccaag

SEQ ID NO: 80 - DNA, 226 bp, Artificial sequence
  Synthetic polynucleotide
gacggatccgccggattatgtccgctgagtgggtcacggtcccggatcagttcccttgcgaagctgaccgatgtttttgtgccaaaagctgttgtggcaaaaaacggtttgcgcaaagttttgtattacaaagaatttcacattttaaaatatctttataaatcaatcagttatttctatttttaagctggcatggttatcgctatagggcttgtacagatctgtc

SEQ ID NO: 81 - DNA, 1622 bp, Artificial sequence
  Synthetic polynucleotide
cagagatctactttataaggaggaaaaacatatggatctgcccgacgatcattacctgtccacccagaccatcctgtcgaaggatctgaatggcaccgacgtgggctccggtggcgggagtggtggtggcgggagcaaggtctccgccctcaaggagaacgttagcgccctgaaagagaaagtctcggccctgaccgaaaaggtctccgcccttaaggaaaaggtgagcgctctcaaagagtaaccaggcatcaaataaaacgaaaggctcagtcgaaagactgggcctttcgttttatctgttgtttgtcggtgaacgctctctactagagtcacactggctcaccttcgggtgggcctttctgcgtttataggtacccgaagactgggcgggcagcagcccactcccaagcgcccaccaattatgacttctttttcatagacttaattcgacgtcatgaagcagtcgtaacgggtgttcgccatccgaccgctctacatcctcgatcaacggatcgccaagcgaccacccaaaccgcctaggtaactaaagattaactttataaggaggaaaaacatatgaaggtctccgcccttgaaaatgaggtctcggctctcgaaaaggaggtgtcggtcctggagaaagaagtcagcgcgcttgagaaggaggtccgtgccctggagaagagtggcggtggggggtctgggggcggttctgggggcggctccacctcggagaagcgtgaccacatggtgctgctcgaatatgtcaccgccgccgggatcaccgatgcctcctaagactcctgttgatagatccagtaatgacctcagaactccatctggatttgttcagaacgctcggttgccgccgggcgttttttattggtgagaatgaaaaatgctgtacccctgaaattcggctattgtcgacgtatgacgtttgctctatagccatcgctgctcccatgcgcgccactcggtcgcagggggtgtgggattttttttgggagacaatcctcatgcgtaagggcgaagagctgttcacgggcgtcgtccccatcctcatcgagctggatggcgatgtgaacggccataagttcttcgtccgtggggaaggcgagggggatgccaccatcggcaagctgagcctcaagttcatctgcaccaccggcaagctcccggtcccctggccgacgctcgtcacgaccctcacctacggggtgcagtgcttttcccgttaccccgaccacatgaagcggcacgacttctttaagtcggccatgcccgaaggctacgtgcaggagcgcaccatctattttaaggacgatggcacgtataagacccgcgcggaggtcaagttcgaaggggataccctggtcaaccgtatcgagctgaagggcatcgactttaaggaagatggcaacatcctcgggcacaagctcgaatataattttaactcccataaggtctacatcaccgccgacaagcaaaacaacggcatcaaggcgaactttacgatccgtcacaatgtggaggacggcagcgtccagctcgcggatcattatcaacagaatacccccatcggcgatggtcccgtcctcctcccgtagctcgagatt

SEQ ID NO: 82 - DNA, 555 bp, Artificial sequence
  Synthetic polynucleotide
tgaggattttgtgcgccaggcatcaaataaaacgaaaggctcagtcgaaagactgggcctttcgttttatctgttgtttgtcggtgaacgctctctactagagtcacactggctcaccttcgggtgggcctttctgcgtttatacctagggaacgatagcgccgcctgcgagcgcgacctcaggcctcggacgaagcgcgtccggggccttttcttgtcgatgttcagcgcctggttaccggcgatggcgcggtgtcagcgttcgggcgttgcgatgcgtcaggagcgtgtcaggatgcctgtggaatcctaagcgccatcacccagtcccgatctttccgagctccctaactaactaatcatctactttataaggaggaaaaacatatgcgcattctgattatcgaggacgacctggaagccgccggcgccatggcgcacgggctcaaggaagccggctacgacgtcgcccacgcgccggacggcgaggcgggcctggccgaggcccagaagggcggctgggacgtgctggtcgtcgaccggatgatgcccaag

SEQ ID NO: 83 - protein, 3 aa, Artificial sequence
  Synthetic polynucleotide
  MISC_FEATURE (19)..(21): each of N19 to N21 can independently be any nucleotide
  MISC_FEATURE (19)..(19): N19 is any nucleotide
  MISC_FEATURE (20)..(20): N20 is any nucleotide
  MISC_FEATURE (21)..(21): N21 is G
NNN

SEQ ID NO: 84 - DNA, 201 bp, Artificial sequence
  Synthetic polynucleotide
ccctttgcaaaccatatactcaaacgacccaagcaatatggtcacaaaaacttcaaacattacagactgtttagaatattaaagccccgtaattctcttaattacgcgtcatgactgaggtgtaacgagacttcgcgagaacccgaatgtatccaatattcatcggcgcagcgaacagcgcccagccagagggatacttca

SEQ ID NO: 85 - DNA, 201 bp, Artificial sequence
  Synthetic polynucleotide
gaagacccaagttttgcggttaatcatttacgaagactgggcgggcagcagcccactcccaagcgcccaccaattatgacttctttttcatagacttaattcgacgtcatgaagcagtcgtaacgggtgttcgccatccgaccgctctacatcctcgatcaacggatcgccaagcgaccacccaaaccgaggatcaagaca

SEQ ID NO: 86 - DNA, 119 bp, Artificial sequence
  Synthetic polynucleotide
acctgcgcctgggccccacggcggacgggtcgcggcccggcgccaccttgcaaaggtttaatccacctgtccggcttgtaacttccctcaaggggagccgagaggcaccgtcgaaccca

SEQ ID NO: 87 - DNA, 201 bp, Artificial sequence
  Synthetic polynucleotide
ggagcggcggtctcagaaaggtggcgaaaataaagcactgatcataagtaaatcgcgatcatccaagtaatgacgccgggcaatcgattgtagaaagatgaaaatctcgtaatgctatcggatatgtaatctacatgtcaggcttgtaacttgagatgaatgttcggggcgttcagacctgtcgccactgaggggaaccag

SEQ ID NO: 88 - DNA, 201 bp, Artificial sequence
  Synthetic polynucleotide
tcacgcgtcttcatggggctgctccttgcgacatcggcgacgaaacacgccgtagacgcccagatgggggtcgcccggaggcgcgacaatggtcgaaccgcatcaccggggcaggcgccgtgaagattacagtcaattaaattgaacgccgttcttccttttcggaaagtgccttgggaacttccggaccgagggacgtgg

SEQ ID NO: 89 - DNA, 201 bp, Artificial sequence
  Synthetic polynucleotide
cagacacgcggcggtttccgcgacggaagagtgtcgaggcgggcgcatacgcctgtggcgcgaatgccacttggagtccctcacccgcaacattgccgaaaagaaatttgtcccggcgcgtcggagcgtctttacggctgggggtcgagaccgcgcggacgtccgcagcgtatcgctcgacacttgaagttgaggtctccc

SEQ ID NO: 90 - DNA, 201 bp, Artificial sequence
  Synthetic polynucleotide
atgcaggccgcctcaggggacaaagtttctcacgaaacggccttgtgcgatcacattacaccgctgtaacctcgattacgcgcgtcaacgttccttaaatcggcgtcatgaagcaagagtaacgtgtaataaccatggggcggacctatatccctctcatcggacgccaacggggcggccgaagaaaaaagggatcaagac

SEQ ID NO: 91 - DNA, 201 bp, Artificial sequence
  Synthetic polynucleotide
taaccagaccgcaaggcgcctaagtcataagcctcttaccgccgaggccgcgcgccggctggcgagcgacgaggtctgcccttcagcgaggccggccccgactatttcatgcctgaaacgcgccttaccccgatttaacttggccactcgtcgatcggcgttcattgctgcaaccgtcgattgggggagcacgagtccgca

SEQ ID NO: 92 - DNA, 201 bp, Artificial sequence
  Synthetic polynucleotide
gcggagatggatcgcgcgacgggtctgaaacagagtcagttgagccaggcgtgcggcgatgactccacgttgttgccccgcggactttccattccgcgctgccgttaaatccccgtcattaccgcaatttaagtggtctctggccctccgtcggtccaaaccgtaactcacacagtcgcgtatggactgaacggagtagtc

SEQ ID NO: 93 - DNA, 201 bp, Artificial sequence
  Synthetic polynucleotide
acccttatggcatcggcggtggatccgcgcctcttgaaggatgaccagcatgcggatgcgcggctggaaaagccgatcacccctggacgtcttctgcagacggtgcgcgcgctggaaagccgccacgcagcgtgacagaactttaagctgaccccgaccacttcgcgcccctagggtgtgacgcgtttttggggagctcac

SEQ ID NO: 94 - DNA, 201 bp, Artificial sequence
  Synthetic polynucleotide
gctcgacccggcgttcgcggcggggctggaggcggcggccaaggccggggtggaggtgctggtctatgcgtgtgaaatggggacgcaggcggtgcggatcgcgcggcgcattttgtggagccacgcccacctaacagcgatttaagctgcatttcgcgcccgctgagctaacccttctgcaggctcgcgaaatggggatcg

SEQ ID NO: 95 - DNA, 201 bp, Artificial sequence
  Synthetic polynucleotide
gaaagagtgttcaggcgcaacctgggggaaggtcccaaggcctagactggcacctagggccgagcgacgcttgcgacaaccgtcggaattctaagggtgctgtcagatgtcgtggagcccccttgcaagaccatcggcccttcatgaccaaaagttcactcgcctgctttgcgaaatgctcgcataacgccgctatgggat

SEQ ID NO: 96 - DNA, 201 bp, Artificial sequence
  Synthetic polynucleotide
ggttcgccgcgcgatcgcatggcgtgacgaccatgactagaggggccaagcgccagaacctgtcagctaagccgcccagcgacgccgaacgccgttaccgcgatggggcaaacctgtagaattgttcatgaacccggacattttcgcgccataaccgcgtggccaagctccaggctcggactacgacagggagctcacaac

SEQ ID NO: 97 - DNA, 201 bp, Artificial sequence
  Synthetic polynucleotide
cctcgatgatcgcgaccgacccctccacggcctgagtgtgcgccgatagcgcgggcgacacgccgccgccgatcattgccaaagtttaatatcgtttctcgataaacgacattggcggaaccgcaaacccggcctatctgttcagtgtggcgaaggggcgaatgtttcggccctggccatgtctctcaaactggaaaaagc

SEQ ID NO: 98 - DNA, 201 bp, Artificial sequence
  Synthetic polynucleotide
tcgtacggcgatggtcgatgtgcatggccagttggatgaaactcgcttgcgccttggcgttaggacccgcatgggcggctcgctcaagccgatcgaggaaaccacgcgtgggttgaaggaagtcggctgagcaacgatcaaccggacattgcgatagtttaataaccttgggcctctaatttaggttagaggcccaagtca

SEQ ID NO: 99 - DNA, 201 bp, Artificial sequence
  Synthetic polynucleotide
ctcgcgacgctcgctcgccgctatccccggctgggcgcggcgctgggcctcggcttcggcctggtgggtctggcgatgatggtggactagcctgaccccaacatgacttcgcggtcatgacctcgaattaagtcgaaaccttgtcggcccctcggtagcctctcctcatcgaatttcaacacgcgtccttggggagacact

SEQ ID NO: 100 - DNA, 201 bp, Artificial sequence
  Synthetic polynucleotide
ggtacgaacgccgcggctaccgcctgaccggcgaaacccagcccttcccctatggcgacgaccgcttcggcctgccgcagcgggatgatctggcgttcgtggtgatggagaaggggctgtagggccccattaccgaaccttaagtagctccgtccgggccgacgcgttcagatgccgcgtcttcggctcagggactctcca

SEQ ID NO: 101 - DNA, 201 bp, Artificial sequence
  Synthetic polynucleotide
cctgaccgatcgggtctatgactgggtcgccgcgaaccgctatcggatcttcggcaagcatgaccagtgccggatcccgacgccggcgcaacgggcgcgctttctgatcgactagccccgcccctatatgaactctcggtaaggtttcccggcgaaccggcggtgctagggtcccgcgcaaacattcaggagactctcgcg

SEQ ID NO: 102 - DNA, 201 bp, Artificial sequence
  Synthetic polynucleotide
gtcgtgggcgctgatcatctccggctcggtcgtctatgccggaatctacctgctggcgctggcgccggtgggcaagagccgctgggcgcgccgctggcagcttctgaagtagggcggtgaattcggcgtaatccgcgtcgaatccccttcacagcgacgccttgcggagccacctctagggtctcttcctggggcagcaca

SEQ ID NO: 103 - DNA, 201 bp, Artificial sequence
  Synthetic polynucleotide
ctgcatggcgcgctgctgaaaaacgagcaggacgtccatctgttcgaacgtctggcgttcctcgcccgccgcgaaggctcgggcactcgtccgggccagtaaggcgtctgcggcgaaacggccgttaccgggatttcactggacgcgcgccagacgcgcggccaccttcccgcccatcaggggacggccgaggaaacacca

SEQ ID NO: 104 - DNA, 201 bp, Artificial sequence
  Synthetic polynucleotide
gtcggccgtcgcgccgcgttcgacgcttcgccgccgctgctcgccggcttcgaggctgagacgggcttcagcttctgacgatctgggcccgatggaccgtcgcaacgtttgcgtgaaaaaagcttaactggcgacgactggcggagcgacttacacgcgatcatattgtggccggcgcgagcttcgcgtgattggggatag

SEQ ID NO: 105 - DNA, 201 bp, Artificial sequence
  Synthetic polynucleotide
accagggacagcaggcggcgcaggatcatcttcgggctcgacttggaacgacggttccagcggtcatccatggcccagattgcaggcgtatgacgaccggcggtctccgaggcatgacaccctcttaacttggcgtgggcgggcgcgctcgccatagtcttcgcgtcgagtcgactcaggtcggcgtccggaaccgctcca

SEQ ID NO: 106 - DNA, 201 bp, Artificial sequence
  Synthetic polynucleotide
tgcagccgaacgccaggcgcgcgggcaggcgcgcctcatggaactcgctcatcaagcgatccttctggaaagtcgagaaaaggtttgaggaaaagcaagacggcgcttagtcgacgccattaagacgacgtcatgacccgcttttcacttcttgcgcgggacatcggtctctaggttagggatcgagattggagaccacga

SEQ ID NO: 107 - DNA, 93 bp, Artificial sequence
  Synthetic polynucleotide
gaagaacagcggattcttaattcgcatccatgaaagggccccgcagcgatttcgccatggtctcgccacagagtggcggcgagcttggccgcg

SEQ ID NO: 108 - DNA, 201 bp, Artificial sequence
  Synthetic polynucleotide
ggtctcgtcagttatggaagtcctgtgcggcattacatttccgttaggtcagccaaacgcgcggcgccggaggttgacttgcgacactccagctcttatgtccagcccacatgagaatgaacgttcattctcaaatcgttcatcatagtggccgcgtcaagggtaagagcccgcgcgaccctcgcctcccggggtcaaaca

SEQ ID NO: 109 - DNA, 201 bp, Artificial sequence
  Synthetic polynucleotide
aacccgggcaaatcctttcccggcccggatcccctgcaaggccgccgcacgttccccaacgtcggcggcctttttgcgtcgcttctcgcgccgaggcccgacccgccctgtaaaaaatgggtcacatgaactttttttaagggggtaaagttttcgcgccgttgcagattgccggcggctcacaccaacggatgcgaattc

SEQ ID NO: 110 - DNA, 201 bp, Artificial sequence
  Synthetic polynucleotide
cctggcgataacgccggtcttcgcgccaaaacctgcccaagattacaaaacgttcagactcccccgtctcgacaagctgtcacaggctcgacatggttcgccgccgtcgcggacttgggggtctgcggtgcggggattggggcggtcgcgcctccaacaccaaacataattttggctacacgcccgaggagcgtctcaagt

SEQ ID NO: 111 - DNA, 201 bp, Artificial sequence
  Synthetic polynucleotide
cggccgcctagcaacagcgacgctccgggagttggtcgtcgttccaccctatgtgatccgctattatgtggctgacggtctggtgcatatcgtccgcatccggcacgccgcccggttgtgactttttcgtaattcatcctgggttcaggcggcgagcggtcctctcacggtcaagctgaccaaaaagaggggacaccagca

SEQ ID NO: 112 - DNA, 201 bp, Artificial sequence
  Synthetic polynucleotide
aaggacgccgccgagcagtcagggacctatctggcgacctggaagaaggtcacgggccagtgggtgatcgagaacgagcttttcgtgacgctggcttgagcgacgggcctcttcccagcgagtatgacgcggaattaattaagcccaaacaggggcggggcttacgccttcgtccttcaatgcgcctctggggaggaaaac

SEQ ID NO: 113 - DNA, 201 bp, Artificial sequence
  Synthetic polynucleotide
cgcctggggcagacgctgcacgagggcgcggtggaccgagaggccgcccacgccagagtcaaagacgccgatcatgggccaagctgtagccgccaaagcggggcgcgtccacgcactggggaaggttacagtcctgtcatgtgacaggtcggccgcccatatcctagggtcacggccaacactttcaccggagatcctccg

SEQ ID NO: 114 - DNA, 201 bp, Artificial sequence
  Synthetic polynucleotide
gcgaccaggcgggcttcgagcgcggcgtgagacatgggcacgggacagctactccgatccttcaacgacctatgtgaccgggattccttaaaaacggccataccccgggcccacaggttacaaccctagttataaaaccactcatcgttatgaccgagaattaattgaatgtggcgcccgctccgggccatgtagcgccca

SEQ ID NO: 115 - DNA, 201 bp, Artificial sequence
  Synthetic polynucleotide
ggcgccgtatcggccgccaagcggagccatagccactcgaagcgcgttcggctccttggcggtattggtgcgggctctcgccgcattgcactaaagtcatgtgaacgatcattctcattgtgctagaagcgcggaatgaggtgatccggtcgctttgtcgtgcgtatctctcctgtccgttgctggtttcgaggcgaccca

SEQ ID NO: 116 - DNA, 201 bp, Artificial sequence
  Synthetic polynucleotide
cgtcatcgccatgccacgtccctcggtccggaagttcccaaggcactttccgaaaaggaagaacggcgttcaatttaattgactgtaatcttcacggcgcctgccccggtgatgcggttcgaccattgtcgcgcctccgggcgacccccatctgggcgtctacggcgtgtttcgtcgccgatgtcgcaaggagcagcccca

SEQ ID NO: 117 - DNA, 301 bp, Artificial sequence
  Synthetic polynucleotide
gtcgtcctgcagcgtcggcgggacggcggtgtctggggtggggtcggtcacggttgagcctggaatagtcttgttatccagatcgtcgcgctgatcaggccgtgatgcaaatgaaggtggcgtcatgaaggcgatgtcacgttgggcgcgtccgccggaccttacaaaaaagtcatctcctcggatcgatccggcgccgacgccgggccgtaatcatcatcagaccgcgcgccgtcgaccgcttcagatcccccaacccgaagacttgatggaaggtttcagacaatgatgcgttcgatgc

SEQ ID NO: 118 - DNA, 301 bp, Artificial sequence; identical to SEQ ID NO: 117
  Synthetic polynucleotide

SEQ ID NO: 119 - DNA, 301 bp, Artificial sequence
  Synthetic polynucleotide
aaggacgaggatttccagccggcctcgcgccgaaatcttggcgacgaagccttttccccgggggaaggcacgtttgcagccggatcggtagcgaaatgcgtcacgcgtgcaaacaccgcgcgctgaaacattacatctgagaaatatttgacctcagacgccagtctgcgtcagaacttcgctcgcgtgagattccggccgatccggaacgggcgagaccgtgccccaatcgcgggccactgggaggagagaccttggatagacgacagttcctcgcggcctgcggcatcggcgccggggg

SEQ ID NO: 120 - DNA, 301 bp, Artificial sequence
  Synthetic polynucleotide
catgcgaaacgccaagcgccgctttcgcggcgccgagggctttgattttagaggattttcccgcctctggctggcggggaggaaatggtcggagtggcaggatttgaacctgcgacccctgcgtcccgaacgcagtgctctaccagactgagccacactccgacttggaggccggccttataggtgggtgttccggggggcgcaagcgcctttttgcaggttggtcgggaggcctgaaaaaagttctgaaaaggtcgttgcatccatccgagtcgtgagctatctccaccgcctcgccggg

SEQ ID NO: 121 - DNA, 301 bp, Artificial sequence
  Synthetic polynucleotide
cgcgccggtgctgaacgtgctgatcggcgcgctggcgccgggtctcgcccccgctgcggcggcgctggccctggtggcggccacgctgctggtcagcagtccctcggtccggcggcgactgggcttggccgccgtttagcgccttacgaaagtttcatggcgagcggcgcctccaaacgggggcgtgagcgcctcttaccagtgaaggcggcgctgtggcgtcgttcaccgaactggaggatttgagaatgggtcccgaaatcatcgtcccggtcgcgctcttcgcgatgatctgcgccgt

SEQ ID NO: 122 - DNA, 301 bp, Artificial sequence
  Synthetic polynucleotide
ttctcgtggcgcgcctgcgccgaggagttcttccgcaacctgcagccctatccggaaccggaaaagacccgcttctggcgccggctgcggcgcctggcgcgcctgcgcaagaagacggcggcgtagtcgcttcctgtccgcattgtaattggcgcggcgcgcagacctcggataacgctggtctctcgatagggagggcggcatgaagctcatcatgatcgtcatgggactgtgtctggcggtcagcgccgcccaggcccaaacgagcacgcccgcgcccgtcatcgagacctacaagaca

SEQ ID NO: 123 - DNA, 301 bp, Artificial sequence
  Synthetic polynucleotide
cgcgcatcgctagcccttgccaagcgccagagcccacgcgctgagcatgggaacagcccgtaacccccgccccgagggggttcagtcgcgaatgcctctcagaaacccccgaattcggcgtccggatcattacgtatcattcatgagtaggtaccttgcaccactcagtaccgggcggtacaagggagcatcaacggaggcaaggacgccgtgccggaaacaattgaaatccaactgaagaaaggcgtgctggcgctctgtgtgctggctctgctctcgcacgccgacagctacgcctacg

SEQ ID NO: 124 - DNA, 301 bp, Artificial sequence
  Synthetic polynucleotide
ccagcacctcctcggccggcttggggctgtcggcccagagcaccttcatgacttcgctctcggcgccgctgatacgttgtgatgtcgtttccatgagcgaacgattacgcacgtaaacgtttccgtcaagtgatcgattacgcacgtaaacgaaatgtaatgcagcgttggaggcgtaagcgaagcggcttaacgctcgagagcggaggagtcgtacatgccagacacgcttcagcttggcctgccgggccttgagtcgcccacgccgacggatcggctgatgttcctgctgtatcctgac

SEQ ID NO: 125 - DNA, 301 bp, Artificial sequence
  Synthetic polynucleotide
gcccgggacgatctgggtcgccagccacaagccgaaggcggcgatcagcaggcgaaaaatgagacggaccatgacttctctccaacttcagccgcaacgcgtccaaaccatcgccgcattcgtacaatatccgagcccgaaactcggacattacaaatgcgttaccgctcttcaaactgccgcagcgtgaactatctaccctcctgtgtgggggatgatcgcgcgcgattggcgagcggatccgcacgcaaggggatatgagtaagatggccgtgaattctctatcggtgatgtcgccgga

SEQ ID NO: 126 - DNA, 301 bp, Artificial sequence
  Synthetic polynucleotide
ctcgtccccgatcaggacaatccgaccctcgtgaccatactggcgcaggaacgcggcgaccgagccgcccgcgtgacccgcgccgacgatgacgacgcatgcgttctgattaacttcagcgctcaatgacgccctccctttcgtcaaaaatgacgccggcgtcacctattggcaagcgccttcgacagaggcggatacggaatggggcggctcgtttccgaagccgccccacatttatcgctctgcagcgtgcgtcagacgacgcgctcgaccatcatcttcttgatttcggcgatggcct

SEQ ID NO: 127 - DNA, 301 bp, Artificial sequence
  Synthetic polynucleotide
tgaatagtccgcctggagctcgatagctctcccccccagcggacccgcttcgctgcgctcgacccgttacgcccctcacgaggaccagcctccagaaggatcgtttcgaagcgcgtgcaaccgacgcccttttggggctccggtcttaccgcaatgttagaattgcggctggggtcctttggcaaccccttttcgtaccgtcaagggtctcatttgggcacaaattcatcgtcacgcccccgcccccctggcgtttgccgcagtgcacaaaacggttttccggatttcggggcggtttttc

SEQ ID NO: 128 - DNA, 301 bp, Artificial sequence
  Synthetic polynucleotide
gtttcgggagcggaaaatagcctagaaaaaacagcctcatgtttgtgagcgcgtgctgttttcgatgcttgcgtatccatattgagcaatgattttccgaaaagcgttcctcctgtggcgattttgcgacaggggggtcgggataatgattacttttttgcaatcagaattgaccctcgcccgatccaccccctaacgtcgctgcaaccggaagagtttgttccgggacacatgtgatcgcgtggtggatttacagcggatttcggctcgaaaacggacaggtcgctgaggggcttcttgt

SEQ ID NO: 129 - DNA, 301 bp, Artificial sequence
  Synthetic polynucleotide
agcccgattggcaacctgtcaatccgtcaacttggggggatttgcgcacctagcgcccaccagcatgggcgataagtggcgcaaagaagacacacatcgcccgtttcgagccgcctcgccgcaccgaacggtcatcgtttgcagatttttgtgttgattacggtccgttaatttgcagtaatttgcagcaacggcccgccgcatgacctcaacagcgcagagccggacagggagggaactcgtatgaacacccaattttcgcgccgtcgcgcctggctgatggccggcggggccacgggcc

SEQ ID NO: 130 - DNA, 301 bp, Artificial sequence
  Synthetic polynucleotide
gatgacaaggaaatagccggcggccatgcggtcgaaggcggtttcaaaggcgttcagcgtgcggttcatgatggaagtccctcattttggcttgccccgaccccctgtgggtcatcgccctcgaaagttacgaggcgatctggacagtgcttagatagcaccaatctgaacgccgtcaagatggtctttacagcgtttagatgaaattttagaaagctatggttagagtgaggccgatgagcacagcgaccgccgaatcccgcccctatcaccatggcgatctgagccgcgccctgatcga

SEQ ID NO: 131 - DNA, 37 bp, Artificial sequence
  Synthetic polynucleotide
attcttcctttttcaatattattgaagcatttatcag

SEQ ID NO: 132 - DNA, 30 bp, Artificial sequence
  Synthetic polynucleotide
aagcttaataagatgatcttcttgagatcg

SEQ ID NO: 133 - DNA, 34 bp, Artificial sequence
  Synthetic polynucleotide
catcttattaagcttttacgccccgccctgccac

SEQ ID NO: 134 - DNA, 49 bp, Artificial sequence
  Synthetic polynucleotide
tgaaaaaggaagaatatggagaaaaaaatcactggatataccaccgttg

SEQ ID NO: 135 - DNA, 30 bp, Artificial sequence
  Synthetic polynucleotide
gacgctagcctgcgcaacccaagtgctacc

SEQ ID NO: 136 - DNA, 30 bp, Artificial sequence
  Synthetic polynucleotide
cagaagcttggatatgtggacgatggccgc

SEQ ID NO: 137 - DNA, 30 bp, Artificial sequence
  Synthetic polynucleotide
gacggatccgagtcagttgagccaggcgtg

SEQ ID NO: 138 - DNA, 32 bp, Artificial sequence
  Synthetic polynucleotide
gacgaattccgttcagtccatacgcgactgtg

SEQ ID NO: 139 - DNA, 27 bp, Artificial sequence
  Synthetic polynucleotide
atagcgcaatttaagtggtctctggcc

SEQ ID NO: 140 - DNA, 36 bp, Artificial sequence
  Synthetic polynucleotide
cttaaattgcgctattgacggggatttaacggcagc

SEQ ID NO: 141 - DNA, 21 bp, Artificial sequence
  Synthetic polynucleotide
aatgtggtctctggccctccg

SEQ ID NO: 142 - DNA, 36 bp, Artificial sequence
  Synthetic polynucleotide
gccagagaccacattaattgcggtaatgacggggat

SEQ ID NO: 143 - protein, 294 aa, Caulobacter crescentus NA1000
MLIIENLTHVYGNGTRALDEVSLTIPRGMYGLLGPNGAGKSTLMRTIATLQAPTSGHIRFGDIDVLKHPEELRKTLGYLPQDFGVYPRVSAYDMLDHMAVLKGISGGKERKATVEHLLNQVNLWDVRKKAIAGFSGGMRQRFGIAQALIGDPRLIIVDEPTAGLDPEERNRFLNLLAEIGENVVVILSTHIVEDVSDLCPAMAIICNGAIVREGAPADLVAQLKGRIWKKIIDKAELEAAKARYKVISTRLLAGRTVIHIESETDPGDGFTAVEGGLEDVYFSTLSSTRSRQAA

SEQ ID NO: 144 - protein, 1195 aa, Caulobacter crescentus NA1000
MFGKIAGFELRYQLKSPVFWVVAVIFFLMTFGAATIDQIRIGGGGNIHKNAPYAIAQTHLILAIFYMFVTTAFVANVVVRDDETGFGPILRSTRIRKFDYLYGRFTGAFLAAAISFLVVPLAIFVGSFMPWVDPERLGPNDLNAYLFSYFALALPAILLTSAIFFALATVTRSMMWTYVGVIAFLVLYIIAGIALDRPEYEKGAALWEPLGTAAFGLATKYWTASERNSLTPPLAGALLFNRVFVLVLAAGFLALAYSLFRFQSAELSGQRKSAKKTKAAPTEAAPAASGPLPTPVFDRRTAWAQLVVRTRLDMGQVFKSPAFFVLLFLGLANAMGALWFATEAGRYGGVVYPVTRILLFPLLGSFGLIPIIIAIYYSGELVWREREKKTHEIIDATPVPDWAFVAPKTLAISLVLISTLLISVVAAMLSQVFHGYFNFELEKYLLWYVLPQALDFILLAVLAVFLQTISPHKFIGWALMVIYIVSTITFTNLGFEHKLYNYGATTETPFSDMNGLGKFWMGAWWLRAYWTAFALVLLVLAYGLWRRGTESRLLPRLRRLPLRLNGGAGALMGVSLVAFAGLGGFIYVNTNVWNEYRTNIDGEKWQAEYEKTLLPFENTPQPKIIAQTLDIDIQPHAPSLETKGSYVLENKTGAALKEIHVRFDRDLEVKGLSIEGARPKKTFEKFNYRIFAFDTPMAPGEQRKMSFITLRAQRGFPNSGAETRVVDNGTFVNNLEIAPILGMSRDGLLTDRAKRRKYGLPPEQRMAKLGDVSSMQFNGLRKDADFIQSDITVTTVADQTPIAPGYKVSDSVRNGRRTARFVTEAPIMPFVSIQSARYKVAEETYKGVQLAVYYDPQHAWNIDRMKTSMKRSLDYMGTNFSPYQFRQLRYQEFPDYAQFAQSFANTIPWSEGMFFISDYRDPTKIDMVTYVGAHEIGHQWWAHQVIGANQQGGAMLSETFAQYSALMVMKHTYGEDQIRKFLKFELDSYLRARGGDVIDEQPLYKVENQPYIYYRKGSLVMYRLQDQIGEEAVNRALRKLIADHAFKGAPYPTTLDFMAALRAEAPADKQALITDLFEKITLYDLKTKSAAVKKRADGKFDVTVVVEAQKKYADGKGKETVAALNETMEIGLFTAKPGDKGFVAKNVVLYQRRPIRSGENTFTFIVDKAPTFAGIDPYNTVIDRNGDDNTVKVGG

SEQ ID NO: 145 - DNA, 34 bp, Artificial sequence; identical to SEQ ID NO: 37
  Synthetic polynucleotide

SEQ ID NO: 146 - DNA, 34 bp, Artificial sequence; identical to SEQ ID NO: 38
  Synthetic polynucleotide

SEQ ID NO: 147 - DNA, 22 bp, Artificial sequence
  Synthetic polynucleotide
atgcgcaagttcatcatgagcc

SEQ ID NO: 148 - DNA, 24 bp, Artificial sequence
  Synthetic polynucleotide
gtttgcaaagggttaatcgacgcc

SEQ ID NO: 149 - DNA, 32 bp, Artificial sequence; identical to SEQ ID NO: 43
  Synthetic polynucleotide

SEQ ID NO: 150 - DNA, 23 bp, Artificial sequence
  Synthetic polynucleotide
cgcacaaaatcctcatcctgagc

SEQ ID NO: 151 - DNA, 28 bp, Artificial sequence
  Synthetic polynucleotide
gacggatcccggacggtgaccggcaaac

SEQ ID NO: 152 - DNA, 35 bp, Artificial sequence
  Synthetic polynucleotide
gacgaattccctcgttttcatgtctcgcagctagc

SEQ ID NO: 153 - DNA, 28 bp, Artificial sequence
  Synthetic polynucleotide
gacggatccgaacgatagcgccgcctgc

SEQ ID NO: 154 - DNA, 50 bp, Artificial sequence
  Synthetic polynucleotide
gacgaattcggaaagatcgggactgggtgatggcgcttaggattccacag

SEQ ID NO: 155 - DNA, 23 bp, Artificial sequence
  Synthetic polynucleotide
cgttttcatgtctcgcagctagc

SEQ ID NO: 156 - DNA, 33 bp, Artificial sequence
  Synthetic polynucleotide
ctctttcagggacccttgatgcgcgcgctcgtc

SEQ ID NO: 157 - DNA, 33 bp, Artificial sequence
  Synthetic polynucleotide
caccagagcgagctctcacgccgtcccgccggc

SEQ ID NO: 158 - DNA, 19 bp, Artificial sequence
  Synthetic polynucleotide
gagctcgctctggtgccac

SEQ ID NO: 159 - DNA, 24 bp, Artificial sequence
  Synthetic polynucleotide
gggtccctgaaagaggacttcaag

SEQ ID NO: 160 - DNA, 34 bp, Artificial sequence; identical to SEQ ID NO: 45
  Synthetic polynucleotide

SEQ ID NO: 161 - DNA, 23 bp, Artificial sequence
  Synthetic polynucleotide
cgcacaaaatcctcatcctgagc

SEQ ID NO: 162 - DNA, 32 bp, Artificial sequence; identical to SEQ ID NO: 43
  Synthetic polynucleotide

SEQ ID NO: 163 - DNA, 29 bp, Artificial sequence
  Synthetic polynucleotide
aatcagaatgcgcatggcggagcccctcg

SEQ ID NO: 164 - DNA, 25 bp, Artificial sequence
  Synthetic polynucleotide
atgcgcattctgattatcgaggacg

SEQ ID NO: 165 - DNA, 20 bp, Artificial sequence
  Synthetic polynucleotide
cggcgctatcgttccctagg

SEQ ID NO: 166 - DNA, 35 bp, Artificial sequence; identical to SEQ ID NO: 51
  Synthetic polynucleotide

SEQ ID NO: 167 - DNA, 39 bp, Artificial sequence; identical to SEQ ID NO: 52
  Synthetic polynucleotide

SEQ ID NO: 168 - DNA, 44 bp, Artificial sequence; identical to SEQ ID NO: 53
  Synthetic polynucleotide

SEQ ID NO: 169 - DNA, 42 bp, Artificial sequence; identical to SEQ ID NO: 54
  Synthetic polynucleotide

SEQ ID NO: 170 - DNA, 36 bp, Artificial sequence; identical to SEQ ID NO: 55
  Synthetic polynucleotide

SEQ ID NO: 171 - DNA, 37 bp, Artificial sequence; identical to SEQ ID NO: 56
  Synthetic polynucleotide

SEQ ID NO: 172 - DNA, 28 bp, Artificial sequence
  Synthetic polynucleotide
gatcccggggatttctcttcgcgccacc

SEQ ID NO: 173 - DNA, 28 bp, Artificial sequence
  Synthetic polynucleotide
gaaatccccgggatccctgtgctctaga

SEQ ID NO: 174 - DNA, 27 bp, Artificial sequence
  Synthetic polynucleotide
gactctagacgaagactgggcgggcag

SEQ ID NO: 175 - DNA, 29 bp, Artificial sequence
  Synthetic polynucleotide
gacagatctcggtttgggtggtcgcttgg

SEQ ID NO: 176 - DNA, 29 bp, Artificial sequence
  Synthetic polynucleotide
ttgtcgacgtatgacgtttgctctatagc

SEQ ID NO: 177 - DNA, 22 bp, Artificial sequence
  Synthetic polynucleotide
cgttcacatcgccatccagctc

SEQ ID NO: 178 - DNA, 23 bp, Artificial sequence
  Synthetic polynucleotide
atggcgatgtgaacggccataag

SEQ ID NO: 179 - DNA, 37 bp, Artificial sequence; identical to SEQ ID NO: 64
  Synthetic polynucleotide

SEQ ID NO: 180 - DNA, 42 bp, Artificial sequence; identical to SEQ ID NO: 65
  Synthetic polynucleotide

SEQ ID NO: 181 - DNA, 36 bp, Artificial sequence; identical to SEQ ID NO: 66
  Synthetic polynucleotide

SEQ ID NO: 182 - DNA, 24 bp, Artificial sequence
  Synthetic polynucleotide
ggtcgctaccattaccagttggtc

SEQ ID NO: 183 - DNA, 25 bp, Artificial sequence
  Synthetic polynucleotide
tgcttgggtcgtttgagtatatggt

SEQ ID NO: 184 - DNA, 35 bp, Artificial sequence; identical to SEQ ID NO: 70
  Synthetic polynucleotide

SEQ ID NO: 185 - DNA, 41 bp, Artificial sequence; identical to SEQ ID NO: 71
  Synthetic polynucleotide

SEQ ID NO: 186 - DNA, 39 bp, Artificial sequence; identical to SEQ ID NO: 73
  Synthetic polynucleotide

SEQ ID NO: 187 - DNA, 25 bp, Artificial sequence
  Synthetic polynucleotide
ttatttttgacaccagaccaactgg

SEQ ID NO: 188 - DNA, 31 bp, Artificial sequence; identical to SEQ ID NO: 75
  Synthetic polynucleotide

SEQ ID NO: 189 - DNA, 34 bp, Artificial sequence; identical to SEQ ID NO: 76
  Synthetic polynucleotide

SEQ ID NO: 190 - DNA, 37 bp, Artificial sequence; identical to SEQ ID NO: 131
  Synthetic polynucleotide

SEQ ID NO: 191 - DNA, 30 bp, Artificial sequence; identical to SEQ ID NO: 132
  Synthetic polynucleotide

SEQ ID NO: 192 - DNA, 28 bp, Artificial sequence
  Synthetic polynucleotide
gacggtaccgaacgatagcgccgcctgc

SEQ ID NO: 193 - DNA, 50 bp, Artificial sequence
  Synthetic polynucleotide
gaccctaggggaaagatcgggactgggtgatggcgcttaggattccacag

SEQ ID NO: 194 - DNA, 51 bp, Artificial sequence
  Synthetic polynucleotide
ggaagatctactttataaggaggaaaaacatatgacccgagaccaagacac

SEQ ID NO: 195 - DNA, 24 bp, Artificial sequence
  Synthetic polynucleotide
gacctcgagtcatagggggcgtcc

SEQ ID NO: 196 - DNA, 19 bp, Artificial sequence
  Synthetic polynucleotide
tcatagggggcgtccgtcg

SEQ ID NO: 197 - DNA, 21 bp, Artificial sequence
  Synthetic polynucleotide
gggatttctcttcgcgccacc

SEQ ID NO: 198 - DNA, 18 bp, Artificial sequence
  Synthetic polynucleotide
ggacgccccctatgagcg

SEQ ID NO: 199 - DNA, 34 bp, Artificial sequence
  Synthetic polynucleotide
gcgaagagaaatcccatcatcgccagccctagcg

SEQ ID NO: 200 - DNA, 1622 bp, Artificial sequence; identical to SEQ ID NO: 81
  Synthetic polynucleotide

SEQ ID NO: 201 - DNA, 20 bp, Artificial sequence
  Synthetic polynucleotide
tgcgtgaaaaaagcttaact

SEQ ID NO: 202 - DNA, 7 bp, Artificial sequence
  Synthetic polynucleotide
cgtcagc

SEQ ID NO: 203 - DNA, 97 bp, Artificial sequence
  Synthetic polynucleotide
cccaaagagggtgtggcccaaagagggtgtggatttctcttcgcgccacccgtttcgtcagccggacgtcaggtccagacggctaagctagctgcga

SEQ ID NO: 204 - DNA, 97 bp, Artificial sequence
  Synthetic polynucleotide
atgttcagcgcctggttaccggcgatggcgcggtgtcagcgttcgggcgttgcgatgcgtcaggagcgtgtcaggatgcctgtggaatcctaagcgc

SEQ ID NO: 205 - DNA, 60 bp, Clostridium sp. Maddingley MBC34-26
  misc_feature (1)..(60): ALXI01000102.1/18602-18543 Clostridium sp. Maddingley MBC34-26 contig_203_1, whole genome shotgun sequence
atattttcaggtgatggagttcgcctttaactgcgtaatgctaatgactcctacaaaata

SEQ ID NO: 206 - DNA, 67 bp, Plesiomonas shigelloides 302-73
  misc_feature (1)..(67): KB944507.1/1472202-1472268 Plesiomonas shigelloides 302-73 genomic scaffold scaffold00002, whole genome shotgun sequence
tgccatcgtggagatggcattcctcccttaaccgtcgggtttcccgtctgatgatgcctgctagatt

SEQ ID NO: 207 - DNA, 62 bp, Chloroflexi bacterium
  misc_feature (1)..(62): MGOG01000202.1/8032-8093 Chloroflexi bacterium RBG_19FT_COMBO_47_9 rbg_19ft_combo_scaffold_45167, whole genome shotgun sequence
acaaattaaggcgatgaggctcgccgcaattgtctattaggactgatagcctctgtagaaga

SEQ ID NO: 208 - DNA, 74 bp, Clostridium halophilum strain M1
  misc_feature (1)..(74): FUZT01000010.1/96793-96866 Clostridium halophilum strain M1 genome assembly, contig: G325DRAFT_scaffold00010.10
tttaagatagggaatgaagttctccctggattaatattccaaaccgctgataagctaatgacttctaagcaccg

SEQ ID NO: 209 - DNA, 70 bp, Sphingobacteriales bacterium 44-15
  misc_feature (1)..(70): Sphingobacteriales bacterium 44-15 scnpilot_expt_750_bf_scaffold_50, whole genome shotgun sequence
ttgctaaaaggaaatggtgtcttcctaattgaaccgctcatctttttgggctgatggcgcctgcaggtta

SEQ ID NO: 210 - DNA, 71 bp, Sphingobium sp. TKS
  misc_feature (1)..(71): CP005085.1/264607-264537 Sphingobium sp. TKS plasmid pTK1, complete sequence
ggcatcaacggcgatggatttccgcctggcttcggccgaaccgcctcggggttgatgattcctacctgctg

SEQ ID NO: 211 - DNA, 150 bp, Betaproteobacteria bacterium
  misc_feature (1)..(150): MERH01000282.1/3229-3080 Betaproteobacteria bacterium RIFCSPLOWO2_12_FULL_62_13b rifcsplowo2_12_scaffold_93587, whole genome shotgun sequence
  misc_feature (1)..(150): n is any nucleotide
cagtcgcaaggagatggcattcctcctttaacnnnnnnnnnnnnnnnnnnnnnnnnnnnnnnnnnnnnnnnnnnnnnnnnnnnnnnnnnnnnnnnnnnnnnnnnnnnnnnctcctttaaccgccgcaaggctgatgatgcctacctgacc

SEQ ID NO: 212 - DNA, 62 bp, Candidatus Schekmanbacteria bacterium
  misc_feature (1)..(62): MGDD01000266.1/9395-9456 Candidatus Schekmanbacteria bacterium RBG_13_48_7 RBG_13_scaffold_4973, whole genome shotgun sequence
atgattataggtgatggagttcgccattaactgccgtaaaggctgataactcctactaaaaa

SEQ ID NO: 213 - DNA, 69 bp, Lactobacillus nodensis DSM 19682
  misc_feature (1)..(69): AZDZ01000001.1/10642-10710 Lactobacillus nodensis DSM 19682 = JCM 14932 = NBRC 107160 strain DSM 19682 NODE_3, whole genome shotgun sequence
aagttaatcggcgatgacgttcgccactaaaattaattggtaaatcaatttgatgacgtctactgcaca

SEQ ID NO: 214 - DNA, 65 bp, Gloeocapsa sp. PCC 7428
  misc_feature (1)..(65): CP003646.1/2696294-2696358 Gloeocapsa sp. PCC 7428, complete genome
tctgaactgggtgatggagctcaccctaaccgcctattattaaggctgatggctcctactattct

SEQ ID NO: 215 - DNA, 82 bp, Segniliparus rotundus DSM 44985
  misc_feature (1)..(82): CP001958.1/840150-840069 Segniliparus rotundus DSM 44985, complete genome
cccagacacggcgatggatctccgccgggacagacttcctgtccgaaccgcccccaacgaggctgatggctccttcgcatga

SEQ ID NO: 216 - DNA, 72 bp, Oxalobacter formigenes OXCC13
  misc_feature (1)..(72): GG658170.1/1322864-1322793 Oxalobacter formigenes OXCC13 genomic scaffold supercont1.1, whole genome shotgun sequence
ctctttcaaggtgatggtgatccaccttttccaaccgccacgttttttgtggatgatgacgcctgatatgct

SEQ ID NO: 217 - DNA, 75 bp, Pantoea dispersa strain SA5
  misc_feature (1)..(75): LDSG01000006.1/39539-39613 Pantoea dispersa strain SA5 contig_6, whole genome shotgun sequence
tgcctctgaggtgatggcgtgccaccttacccaaccgccctctggttacagacggctgatgacgcctgacaactt

SEQ ID NO: 218 - DNA, 62 bp, Tetragenococcus halophilus NBRC
  misc_feature (1)..(62): AP012046.1/687349-687410 Tetragenococcus halophilus NBRC 12172 DNA, complete genome
attatttatagagatggtgctctctataactgccagggctggctgatggcgcctgttatata

SEQ ID NO: 219 - DNA, 71 bp, Elusimicrobia bacterium
  misc_feature (1)..(71): MNXB01000100.1/20990-20920 Elusimicrobia bacterium CG1_02_37_114 cg_0.2_sub10_scaffold_372_c, whole genome shotgun sequence
tatatgttaggagatggagttctccattaatcgcttcaacgtttttaaaggctgataactcctacgattaa

SEQ ID NO: 220 - DNA, 60 bp, Acidobacteriales bacterium 59-55
  misc_feature (1)..(60): MKSV01000007.1/1496035-1495976 Acidobacteriales bacterium 59-55 SCNpilot_cont_750_bf_scaffold_4, whole genome shotgun sequence
cggagagaagggaatggggtctcccgaaaccgccgagaggctgatgactcctgccaattc

SEQ ID NO: 221 - DNA, 66 bp, Ornatilinea apprima strain P3M-1 contig_4
  misc_feature (1)..(66): LGCL01000045.1/10653-10588 Ornatilinea apprima strain P3M-1 contig_4, whole genome shotgun sequence
tgatgattgagcgatgaggctcgctcttgaaccaaacgctgataagctgatggcctctaccagatt

SEQ ID NO: 222 - DNA, 61 bp, Mycobacterium xenopi RIVM700367
  misc_feature (1)..(61): LGCL01000045.1/10653-10588 Ornatilinea apprima strain P3M-1 contig_4, whole genome shotgun sequence
  misc_feature (1)..(61): AJFI01000022.1/160240-160300 Mycobacterium xenopi RIVM700367 contig22, whole genome shotgun sequence
gttgacgttggcgatgaagctcgccttgattgccgcaccggctgatggcttctaccgcgtg

SEQ ID NO: 223 - DNA, 65 bp, Vibrio coralliilyticus strain 58
  misc_feature (1)..(65): CP016557.1/373614-373550 Vibrio coralliilyticus strain 58 chromosome II, complete sequence
attacgcaaggtgatggggttccacctacttaaccgccactctggctgatgactcctacagaata

SEQ ID NO: 224 - DNA, 64 bp, Candidatus Schekmanbacteria bacterium
  misc_feature (1)..(64): MGDE01000163.1/4593-4530 Candidatus Schekmanbacteria bacterium RBG_16_38_10 RBG_16_scaffold_45780, whole genome shotgun sequence
tttaaaaaaggcgatggggttcgccattaagcatccataagggattaatgacccctactgaaaa

SEQ ID NO: 225 - DNA, 65 bp, Thermoanaerobaculum aquaticum strain MP-01
  misc_feature (1)..(65): JMFG01000038.1/10101-10037 Thermoanaerobaculum aquaticum strain MP-01 contig_38, whole genome shotgun sequence
actctcgctggcgatggagtccgccgttaaccgcccacccttgggctgattacccctaccccaca

SEQ ID NO: 226 - DNA, 86 bp, Chloroflexi bacterium
  misc_feature (1)..(86): MGNU01000076.1/2309-2394 Chloroflexi bacterium RBG_16_57_9 RBG_16_scaffold_27514, whole genome shotgun sequence
attgccgttggcgatgaggctcgccaggggccggagtggcggccccgaacaactgtcggtgaacgactgatagcctctaccttgtg

SEQ ID NO: 227 - DNA, 72 bp, Acholeplasma oculi
  misc_feature (1)..(72): LK028559.1/250889-250960 Acholeplasma oculi genome assembly, chromosome: 1
atagataaagggaatgaagtgctcccttcgtacatacgtaaaccgcttattgctgatgacttctacagattt

SEQ ID NO: 228 - DNA, 65 bp, Leptolinea tardivitalis strain YMTK-2
  misc_feature (1)..(65): LGCK01000014.1/710379-710315 Leptolinea tardivitalis strain YMTK-2 contig_1, whole genome shotgun sequence
aatagttctggcgatgaagctcgccctttaaaagtgccaatctggctgatagcttctgacctggt

SEQ ID NO: 229 - DNA, 82 bp, Acidothermus cellulolyticus 11B
  misc_feature (1)..(82): CP000481.1/804142-804061 Acidothermus cellulolyticus 11B, complete genome
cctgatgacggcgatggagtccgcctgaccggtgtgatcgacaccggcgaagtgtcacctggctgatggctcctacctccca

SEQ ID NO: 230 - DNA, 60 bp, Fervidicella metallireducens AeB
  misc_feature (1)..(60): AZQP01000012.1/15223-15164 Fervidicella metallireducens AeB contig00012, whole genome shotgun sequence
tattattaaggtgatggggttcacctttaagtgctttgtgctgatgactcctggattgaa

SEQ ID NO: 231 - DNA, 61 bp, Paenibacillus sp. JDR-2
  misc_feature (1)..(61): CP001656.1/4006535-4006595 Paenibacillus sp. JDR-2, complete genome
agtgaataaggcgatggagttcgccattaaccgcctgcgggctaatgactcctaccaatgt

SEQ ID NO: 232 - DNA, 69 bp, Bacteroides sp. CAG:598
  misc_feature (1)..(69): HF986505.1/7297-7365 Bacteroides sp. CAG:598 genomic scaffold, scf205
ttaatcggagggaatgggacttccctgttataaaccgctaatcaagtagctgatagttcctgtttgtag

SEQ ID NO: 233 - DNA, 65 bp, Flavobacterium subsaxonicum WB 4.1-42 = DSM 21790
  misc_feature (1)..(65): JRLY01000013.1/111920-111856 Flavobacterium subsaxonicum WB 4.1-42 = DSM 21790 strain WB 4.1-42 contig14, whole genome shotgun sequence
ttgcataccggcaatgatgtctgccctgaaccgctgcccgcgcagctgatgacgtctgtttaatg

SEQ ID NO: 234 - DNA, 64 bp, Planctomycetes bacterium
  misc_feature (1)..(64): MHYC01000027.1/2817-2754 Planctomycetes bacterium RBG_13_44_8b RBG_13_scaffold_16883, whole genome shotgun sequence
ttaaaacaaggggatggagttcccccaaaaccgcctgaaaaaggctgataactcctaccaatat

SEQ ID NO: 235 - DNA, 72 bp, Eubacterium sp. CAG
  misc_feature (1)..(72): FR887854.1/2121-2192 Eubacterium sp. CAG:202 genomic scaffold, scf14
tatatgtatgggaatgaggttctcccacggattttttccgaaaccgcttttgctgatgacttctgttttata

SEQ ID NO: 236 - DNA, 64 bp, Methanobacterium sp. A39
  misc_feature (1)..(64): LZPM01000007.1/52149-52086 Methanobacterium sp. A39 contig_16, whole genome shotgun sequence
ttttgtatctgcgatggggttcgcattaaccgcttaaaaataagctgatgactcctaacctatt

SEQ ID NO: 237 - DNA, 70 bp, Erwinia mallotivora strain BT-MARDI
  misc_feature (1)..(70): JFHN01000066.1/21329-21398 Erwinia mallotivora strain BT-MARDI contig_66, whole genome shotgun sequence
cagaaccagggtgatggcgttccacctttcccaaccgctccattccggagctgatgacgcctgatgtaac

SEQ ID NO: 238 - DNA, 64 bp, Ochrobactrum anthropi ATCC 49188
  misc_feature (1)..(64): CP000759.1/989075-989138 Ochrobactrum anthropi ATCC 49188 chromosome 2, complete sequence
gtacatgatgggaatggggttctcccgaaactgccagcaattggctgatgactcctgcttgaat

SEQ ID NO: 239 - DNA, 65 bp, Clostridium chromiireducens strain DSM 23318
  misc_feature (1)..(65): MZGT01000023.1/13112-13048 Clostridium chromiireducens strain DSM 23318 CLCHR_contig000023, whole genome shotgun sequence
aattttataggtgatgaagttcgcctttaaacatctctttagagattgatgacttctactacaat

SEQ ID NO: 240 - DNA, 61 bp, Rhizobiales bacterium 63-22
  misc_feature (1)..(61): MKVZ01000019.1/56053-56113 Rhizobiales bacterium 63-22 SCNpilot_cont_500_bf_scaffold_96, whole genome shotgun sequence
gatgtatgaggggatggagttccccgcgaccgccctcgaggctgatgactcctgccagaaa

SEQ ID NO: 241 - DNA, 62 bp, Aciduliprofundum boonei T469
  misc_feature (1)..(62): CP001941.1/738406-738345 Aciduliprofundum boonei T469, complete genome
tctgcttcgggtgatggcgtccaccccgaaacgcccgcgtggctgatgacgccttttcgcat

SEQ ID NO: 242 - DNA, 78 bp, Photobacterium damselae subsp. damselae CIP 102761
  misc_feature (1)..(78): ADBS01000001.1/1408516-1408593 Photobacterium damselae subsp. damselae CIP 102761 Contig58, whole genome shotgun sequence
atcttaacgggagatgatgttcctcctttaaccgcctttctgatctttttctctaaggatgatgacgtctaacaacag

SEQ ID NO: 243 - DNA, 68 bp, Flavobacterium cauense R2A-7
  misc_feature (1)..(68): AVBI01000012.1/64911-64844 Flavobacterium cauense R2A-7 FCR2A7T_12, whole genome shotgun sequence
cagacaaaaggaaatggtgttcttccttacccaaccgcttcacaaaagctgatgacgcctgattaata

SEQ ID NO: 244 - DNA, 72 bp, Propionibacterium freudenreichii subsp. shermanii CIRM-BIA1
  misc_feature (1)..(72): FN806773.1/1914034-1914105 Propionibacterium freudenreichii subsp. shermanii CIRM-BIA1, complete genome
gatgaacgcggcgatggattccgcctgggcctcggcccgaaccgccgtccggctgatgattcctgtcccatg

SEQ ID NO: 245 - DNA, 73 bp, Clostridium sp. 7_2_43FAA
  misc_feature (1)..(73): JH815223.1/216852-216924 Clostridium sp. 7_2_43FAA genomic scaffold supercont2.4, whole genome shotgun sequence
ataatttttgggaatgaagttctcccatgagaaatctaaaccgtcaagtaagactaatgacttctatgattta

SEQ ID NO: 246 - DNA, 76 bp, Robinsoniella sp. RHS robin_c17
  misc_feature (1)..(76): JNGB01000017.1/21296-21371 Robinsoniella sp. RHS robin_c17, whole genome shotgun sequence
aaaataaacgggaatgaggttctccccaggtacaacaatacctaaactgctattagctgatgacttctgttttagg

SEQ ID NO: 247 - DNA, 60 bp, Clostridium sp. IEH 97212
  misc_feature (1)..(60): MRAE01000024.1/40018-40077 Clostridium sp. IEH 97212 scaffold_23, whole genome shotgun sequence
ataattttaggcgatggggttcgccattaaatgcgtaaagctaatgactcctacaaatag

SEQ ID NO: 248 - DNA, 62 bp, Deltaproteobacteria bacterium
  misc_feature (1)..(62): MGPS01000070.1/30145-30206 Deltaproteobacteria bacterium GWC2_42_11 gwc2_scaffold_898, whole genome shotgun sequence
catcaaataggtgatggagttcacctttaaccgctttaatggctgatgactcctacaaatta

SEQ ID NO: 249 - DNA, 62 bp, Mycobacterium xenopi RIVM700367
  misc_feature (1)..(62): AJFI01000022.1/153221-153282 Mycobacterium xenopi RIVM700367 contig22, whole genome shotgun sequence
tcgcggacaggcgatgaggctcgccttgaactgccacaccggctaatggcttctacccgtga

SEQ ID NO: 250 - DNA, 60 bp, Acetobacterium wieringae strain DSM 1911
  misc_feature (1)..(60): LKEU01000030.1/118640-118581 Acetobacterium wieringae strain DSM 1911 ACWI_contig000030, whole genome shotgun sequence
ttcatagaaggtgatggagttcaccaaaattgcttatcagctgatgactcctgcaggatt

SEQ ID NO: 251 - DNA, 73 bp, Erwinia tracheiphila strain BuffGH Etrach_2
  misc_feature (1)..(73): JXNU01000003.1/4160542-4160614 Erwinia tracheiphila strain BuffGH Etrach_2, whole genome shotgun sequence
gtttcgcaaggtgatggtgttccacctttcccaaccgccctgttcgcaaggggctgatgacgcctgataacac

SEQ ID NO: 252 - DNA, 64 bp, Alicyclobacillus macrosporangiidus strain DSM 17980
  misc_feature (1)..(64): FPBV01000014.1/4475-4412 Alicyclobacillus macrosporangiidus strain DSM 17980 genome assembly, contig: Ga0104483_114
atcgaatccggtgatggagctcaccgtataaatgcccattgaggatgatggctcctgtgcatct

SEQ ID NO: 253 - DNA, 76 bp, Vibrio sp. AND4 1103602000417
  misc_feature (1)..(76): ABGR01000008.1/95568-95493 Vibrio sp. AND4 1103602000417, whole genome shotgun sequence
attggggttggtgatggggtgccaccggaatcgaatgattcaaaccgcttgtatagctgatgactcctacagagac

SEQ ID NO: 254 - DNA, 77 bp, Bosea sp. 67-29
  misc_feature (1)..(77): MKSQ01000014.1/173748-173824 Bosea sp. 67-29 SCNpilot_expt_1000_bf_scaffold_308, whole genome shotgun sequence
ttcggcgatggggatggagttcccccgaaaccgcccgccggtcgccattccggtcggctgatgactcctaccgcacg

SEQ ID NO: 255 - DNA, 60 bp, Clostridium perfringens str. 13
  misc_feature (1)..(60): BA000016.3/731613-731672 Clostridium perfringens str. 13 DNA, complete genome
atttttataggcgatggagttcgccattaaatgctttatgctaatgactcctacaaaata

SEQ ID NO: 256 - DNA, 64 bp, Ammonifex degensii KC4
  misc_feature (1)..(64): CP001785.1/1464504-1464567 Ammonifex degensii KC4, complete genome
accacataaggcgatggagcccgccttaaccgcccggagaagggctgatggctcctggtctttc

SEQ ID NO: 257 - DNA, 59 bp, Clostridiales bacterium S7-1-4
  misc_feature (1)..(59): JRMY01000022.1/50889-50947 Clostridiales bacterium S7-1-4 contig22, whole genome shotgun sequence
agtttaatagggaatgaagtttcccgttaattgcaactgctgatgacttctacaatttt

SEQ ID NO: 258 - DNA, 64 bp, Desulfotomaculum kuznetsovii DSM 6115
  misc_feature (1)..(64): CP002770.1/2630559-2630622 Desulfotomaculum kuznetsovii DSM 6115, complete genome
atcacaccaggcgatggagctcgcctttaagcgcctctttcgggctaatagctcctaccagaat

SEQ ID NO: 259 - DNA, 64 bp, Nocardia nova SH22a
  misc_feature (1)..(64): CP006850.1/5427340-5427403 Nocardia nova SH22a, complete genome
tgatctgtaggcgatgaagctcgccttcgaccgcgcccccggcgctgatggcttctaccacggt

SEQ ID NO: 260 - DNA, 63 bp, Streptococcus sp. DD11
  misc_feature (1)..(63): KQ969397.1/92070-92008 Streptococcus sp. DD11 genomic scaffold scaffold00006, whole genome shotgun sequence
aagagtcaaagggatggtgcacccctataaccgctagtgatagctgatggcgcctgttagaaa

SEQ ID NO: 261 - DNA, 71 bp, Bacteroidetes bacterium
  misc_feature (1)..(71): MENL01000062.1/7077-7147 Bacteroidetes bacterium GWB2_41_8 gwb2_scaffold_1940, whole genome shotgun sequence
tttgtgggcggcaatgaggtctgcctttaaccgcctgtcctcctgttcaggctgatgacatctaccaacga

SEQ ID NO: 262 - DNA, 69 bp, Providencia rettgeri strain MR4
  misc_feature (1)..(69): LCVM01000117.1/8488-8556 Providencia rettgeri strain MR4 P_rettgeri_contig_117, whole genome shotgun sequence
aaacctttgggagatggcattcctccttatataaaaccgcccgtagaggctgatgatgcctacgttaac

SEQ ID NO: 263 - DNA, 61 bp, Leeuwenhoekiella marinoflava DSM 3653
  misc_feature (1)..(61): FQUN01000016.1/10512-10572 Leeuwenhoekiella marinoflava DSM 3653 genome assembly, contig: EJ63DRAFT_scaffold00014.14
acatacaaaggcgatggagttcgccaaaaccgcccaaaaagctaatgactcctgctcaatt

SEQ ID NO: 264 - DNA, 62 bp, Frateuria sp. Soil773
  misc_feature (1)..(62): LMSL01000040.1/140723-140662 Frateuria sp. Soil773 contig_8, whole genome shotgun sequence
tcgatgtcgggagatggcatgcctccctgaaccgccgcaaggctgatgatgcctaccatccc

SEQ ID NO: 265 - DNA, 82 bp, Streptococcus sp. FF10
  misc_feature (1)..(82): CTEN01000007.1/29015-29096 Streptococcus sp. FF10 genome assembly, contig: CONTIG000007
ttttatcaagggaatgaggcactccctaaatttctgtaaagaatttaaaccgcgatttttcgctgatggcttctatgacgct

SEQ ID NO: 266 - DNA, 66 bp, Pseudopedobacter saltans DSM 12145
  misc_feature (1)..(66): CP002545.1/4356416-4356351 Pseudopedobacter saltans DSM 12145 chromosome, complete genome
taatcaaaaggaaatggtgttcttccttacccaaccgctttttaagctgatgacgcctgattaatg

SEQ ID NO: 267 - DNA, 70 bp, Kluyvera intestini strain GT-16
  misc_feature (1)..(70): MKZW02000001.1/3834718-3834787 Kluyvera intestini strain GT-16 tig00000000, whole genome shotgun sequence
tgcatgcaaggtgatggcgttccaccttacccaaccgcttcccagcgaagctgatgacgcccccggtatg

SEQ ID NO: 268 - DNA, 65 bp, Shinella sp. DD12 SHLA_40c
  misc_feature (1)..(65): AYLZ02000183.1/23975-23911 Shinella sp. DD12 SHLA_40c, whole genome shotgun sequence
gcgtgggatggggatggagctccccgacaaccgccgtttgaccggctgatagctcctgccaagac

SEQ ID NO: 269 - DNA, 77 bp, Sebaldella termitidis ATCC 33386
  misc_feature (1)..(77): CP001739.1/3350399-3350323 Sebaldella termitidis ATCC 33386, complete genome
taaacttaaggagatgaagctctccgcggtgtatgccggaaccacatgtttttcatgttaatagcttctgcagcgtt

SEQ ID NO: 270 - DNA, 73 bp, Alcaligenes sp. EGD-AK7
  misc_feature (1)..(73): AVOG02000067.1/146393-146465 Alcaligenes sp. EGD-AK7 Contig7, whole genome shotgun sequence
tttcttcctggagatgacgttcctcctttaaccgccgtttcgttctgaagcagctgatgacgtctacagtgac

SEQ ID NO: 271 - DNA, 63 bp, Magnetospirillum sp. 64-120
  misc_feature (1)..(63): MKVK01000019.1/64767-64705 Magnetospirillum sp. 64-120 scnpilot_p_inoc_scaffold_239, whole genome shotgun sequence
gcgtgggatggggatggagctccccgacaaccgcccgcgagggctgatagctcctgctgcgag

SEQ ID NO: 272 - DNA, 82 bp, Clostridium cadaveris strain NLAE-zl-G419
  misc_feature (1)..(82): FOOE01000012.1/96932-96851 Clostridium cadaveris strain NLAE-zl-G419 genome assembly, contig: Ga0070261_112
aaaagtattgggaatgaagttctcccatagtattcttttatgctaaaaccgctgaatttaggctgatgacttctgtgattat

SEQ ID NO: 273 - DNA, 76 bp, Clostridium saccharolyticum
  misc_feature (1)..(76): CP002109.1/3176874-3176949 Clostridium saccharolyticum WM1, complete genome
aatagccaagggaatgaagttctccctgcgctgttaaagccgaaccgcttattaagctgatgacttctgcgattat

SEQ ID NO: 274 - DNA, 76 bp, Tetrasphaera japonica T1-X7
  misc_feature (1)..(76): HF570958.1/4210628-4210703 Tetrasphaera japonica T1-X7 genomic scaffold, 1540_scaffold1
gtgggccccggcgatggatcccgccaggacgcgcagcgtccgaactgccgccccggctgatggctcctgctccgtc

SEQ ID NO: 275 - DNA, 76 bp, Pantoea vagans C9-1
  misc_feature (1)..(76): CP002206.1/3251024-3250949 Pantoea vagans C9-1, complete genome
ccggctcaaggtgatggcgtgccacctttcctaaccgccggtgggcttaacaccggctgatgacgcctgacactca

SEQ ID NO: 276 - DNA, 70 bp, Pluralibacter gergoviae strain JS81F13
  misc_feature (1)..(70): LDZF01000021.1/90063-89994 Pluralibacter gergoviae strain JS81F13 contig_21, whole genome shotgun sequence
ttaatgcaaggtgatggtgttccacctttcccaaccgcttccctgagaagatgatgacgcctggtatgtc

SEQ ID NO: 277 - DNA, 65 bp, Streptomyces malaysiense strain MUSC 136 90
  misc_feature (1)..(65): LBDA02000090.1/15520-15584 Streptomyces malaysiense strain MUSC 136 90, whole genome shotgun sequence
gaacgcgccggtgatggggctcaccgcaaccgcggcgacatgccgctgacggtccctggtcgaac

SEQ ID NO: 278 - DNA, 64 bp, Clostridium colicanis 209318
  misc_feature (1)..(64): KB850961.1/2036-1973 Clostridium colicanis 209318 genomic scaffold acBRg-supercont1.5, whole genome shotgun sequence
ataataataggttatgaagttaacctttaactgcttattaaaagctaatgacttctacaaattt

SEQ ID NO: 279 - DNA, 60 bp, Mycobacterium sp. 1274756.6
  misc_feature (1)..(60): LZLJ01000064.1/71689-71630 Mycobacterium sp. 1274756.6 contig_67, whole genome shotgun sequence
cgcgggtaaggcgatgaggctcgcctgaaccgccgtttggctgatggcctctaccacgga

SEQ ID NO: 280 - DNA, 63 bp, Acidomonas methanolica NBRC 104435
  misc_feature (1)..(63): BAND01000009.1/12481-12543 Acidomonas methanolica NBRC 104435 DNA, contig: Amme_009
acgggtaagggagatggagttcctcccgtaaccgccctcagggctgatgactcctgccgaagt

SEQ ID NO: 281 - DNA, 65 bp, Lactobacillus perolens DSM 12744
  misc_feature (1)..(65): AZEC01000003.1/146176-146240 Lactobacillus perolens DSM 12744 Scaffold3, whole genome shotgun sequence
catctaatcggtgatgacgttcgccgtaaccattacagaacgtaattaatgacgtctacagttgc

SEQ ID NO: 282 - DNA, 63 bp, Aurantimonas sp. 22II-16-19i
  misc_feature (1)..(63): AQQS01000011.1/89624-89562 Aurantimonas sp. 22II-16-19i contig11, whole genome shotgun sequence
gggagtgatggggatggggttcccccgataaccgccatgttggctgatgactcctaccgaacg

SEQ ID NO: 283 - DNA, 66 bp, Burkholderia sp. lig30 ctg20
  misc_feature (1)..(66): JGVW01000053.1/43962-43897 Burkholderia sp. lig30 ctg20, whole genome shotgun sequence
tcgcgcttcggagatggcatgcctcccttaaccgccggtagcccggctgatgatgcctgcgcgttc

SEQ ID NO: 284 - DNA, 63 bp, Deltaproteobacteria bacterium
  misc_feature (1)..(63): MGSS01000136.1/35936-35874 Deltaproteobacteria bacterium RIFCSPLOWO2_12_FULL_60_19 rifcsplowo2_12_scaffold_703, whole genome shotgun sequence
tccattcgcggagatggcgttctcccctaaccgccagccaaggctgatgacgcctgctttcat

SEQ ID NO: 285 - DNA, 74 bp, Papillibacter cinnamivorans DSM 12816
  misc_feature (1)..(74): FWXW01000002.1/266583-266656 Papillibacter cinnamivorans DSM 12816 genome assembly, contig: EJ70DRAFT_scaffold00002.2
ctcaaatgcgggaatgaagttctccccaggcaatggcctgaagtgccttaacggctgatgacttctgcagcgta

SEQ ID NO: 286 - DNA, 67 bp, Acinetobacter haemolyticus
  misc_feature (1)..(67): KB849803.1/86858-86792 Acinetobacter haemolyticus CIP 64.3 genomic scaffold acLrj-supercont1.14, whole genome shotgun sequence
tagggcaaaggagatggcattcctcctgtaacaaaccgccattgtggctaatgatgcctacgttacc

SEQ ID NO: 287 - DNA, 73 bp, Triticum urartu cultivar G1812
  misc_feature (1)..(73): AOTI010612873.1/11168-11096 Triticum urartu cultivar G1812 contig612874, whole genome shotgun sequence
tcgctataaggtgatggtgttccccctttcccaaccgcctcgtccgtaaggggctgatgacgcctgataaccc

SEQ ID NO: 288 - DNA, 63 bp, Mycobacterium triviale strain HMC_M3
  misc_feature (1)..(63): MIHD01000015.1/16307-16245 Mycobacterium triviale strain HMC_M3 PROKKA_contig000015, whole genome shotgun sequence
aatcaaatcggcgatgaagctcgcccttaaccgccgaacccggctgatggcttctacccgaag

SEQ ID NO: 289 - DNA, 80 bp, Zymomonas mobilis subsp. pomaceae ATCC 29192
  misc_feature (1)..(80): CP002865.1/773260-773339 Zymomonas mobilis subsp. pomaceae ATCC 29192, complete genome
tttagcaccggtaatggattctgcctgatcctttgaataaggatcgaaccgccaatcaggctaatgactcctgctcaaac

SEQ ID NO: 290 - DNA, 71 bp, Burkholderia sp. MR1 ctg15
  misc_feature (1)..(71): JWHM01000006.1/60788-60858 Burkholderia sp. MR1 ctg15, whole genome shotgun sequence
cgcccttctggagatggcattcctccaaacaaccgccggctgtcctgccggctgatgatgcctacgagttc

SEQ ID NO: 291 - DNA, 62 bp, Pluralibacter gergoviae strain JS81F13
  misc_feature (1)..(62): LDZF01000020.1/46839-46778 Pluralibacter gergoviae strain JS81F13 contig_20, whole genome shotgun sequence
cccgccgcagaggatggcatacccccttgaaccgccatgtggctgatgatgcctgctttttc

SEQ ID NO: 292 - DNA, 78 bp, Ralstonia pickettii 12J
  misc_feature (1)..(78): CP001069.1/247334-247411 Ralstonia pickettii 12J chromosome 2, complete sequence
ccccgttgtggagatggcatgcctcccttaaccgccggttagcgcgtaacgataccggctgatgatgcctacaagttc

SEQ ID NO: 293 - DNA, 68 bp, Flavobacterium sp. 316
  misc_feature (1)..(68): JYGZ01000003.1/195845-195912 Flavobacterium sp. 316 scaffold_2, whole genome shotgun sequence
gaaatagaaggaaatggtgttcttccttacccaaccgctttctaaaagctgatgacgcctgattaata

SEQ ID NO: 294 - DNA, 70 bp, Betaproteobacteria bacterium
  misc_feature (1)..(70): MEQT01000143.1/7059-6990 Betaproteobacteria bacterium RIFCSPLOWO2_02_64_14 rifcsplowo2_02_sub10_scaffold_2315, whole genome shotgun sequence
cggcaatagggagatggcattctcctccaacaggaaaccgccggaaacggctgatgatgcctgctgggtc

SEQ ID NO: 295 - DNA, 72 bp, Firmicutes bacterium CAG:194
  misc_feature (1)..(72): HF995201.1/10844-10915 Firmicutes bacterium CAG:194 genomic scaffold, scf25
tacagcgtagggaatgaagttctcccttgggaaacctaaactgcttacagagctgatgacttctacgatatt

SEQ ID NO: 296 - DNA, 67 bp, Anaerosphaera sp. HMSC064C01
  misc_feature (1)..(67): LTGD01000049.1/199-133 Anaerosphaera sp. HMSC064C01 Anaerosphaera_spHMPREF2800-1.0_Cont75.5, whole genome shotgun sequence
taaatacatgggaatgaagttctcccacgaaatgaaaccgctataagctgatgacttctgtttttac

SEQ ID NO: 297 - DNA, 74 bp, Ruminococcaceae bacterium D16
  misc_feature (1)..(74): KI391948.1/803048-802975 Ruminococcaceae bacterium D16 genomic scaffold acsPy-supercont2.2, whole genome shotgun sequence
aattctcttgggaatgaagttctcccttggtgaatacctaaaccgctgataaggctgatgacttctgtgagcac

SEQ ID NO: 298 - DNA, 136 bp, Ktedonobacter racemifer DSM 44963
  misc_feature (1)..(136): ADVG01000001.1/1763333-1763468 Ktedonobacter racemifer DSM 44963 strain SOSP1-21 Krac_Contig206, whole genome shotgun sequence
agaataactggtgatggggttcaccacgtcatataatgcctcttcaagagaaacgttcactgaccgattttttatcttaagaagaattggctatacctgacgaaaccgcaaagaagctaataactcctgataacgc

SEQ ID NO: 299 - DNA, 68 bp, Methanobrevibacter sp. AbM4
  misc_feature (1)..(68): CP004050.1/1233497-1233564 Methanobrevibacter sp. AbM4, complete genome
taacattaaggtgatgaggttccacctttaaccgtcagtgattactgaatgatgacttctatttttca

SEQ ID NO: 300 - DNA, 63 bp, Deltaproteobacteria bacterium
  misc_feature (1)..(63): MGRA01000126.1/3058-2996 Deltaproteobacteria bacterium RBG_19FT_COMBO_46_12 rbg_19ft_combo_scaffold_1869, whole genome shotgun sequence
attagtaagggtgatggagttcacccaataaccgccattgaggctgataactcctgcagggag

SEQ ID NO: 301 - DNA, 68 bp, Candidatus Omnitrophica bacterium
  misc_feature (1)..(68): MNVU01000044.1/2332-2265 Candidatus Omnitrophica bacterium CG1_02_49_16 cg1_0.2_scaffold_14807_c, whole genome shotgun sequence
gtagttttaggcgatggggttcgcctgatagctagactgccaatgcggctgataactcctattgttcc

SEQ ID NO: 302 - DNA, 86 bp, Cupriavidus sp. USMAA2-4
  misc_feature (1)..(86): CP017749.1/2317300-2317385 Cupriavidus sp. USMAA2-4 chromosome 2, complete sequence
tgtatgcgtggagatggcatacctccaccccagaagtagagctgggaaaaccgcactttcaaagtgctgatgatgcctacaggtcc

SEQ ID NO: 303 - DNA, 75 bp, Mycobacterium rhodesiae NBB3
  misc_feature (1)..(75): CP003169.1/6228224-6228150 Mycobacterium rhodesiae NBB3, complete genome
tggcgcagtggtgatggatctcgcccgagctcgggtcgctcgaaccgccaaccggctgatagttcctaccgtcat

SEQ ID NO: 304 - DNA, 76 bp, Clostridiales bacterium 38-18
  misc_feature (1)..(76): MKTL01000016.1/298909-298834 Clostridiales bacterium 38-18 SCNpilot_bf_inoc_scaffold_50, whole genome shotgun sequence
accaatgttgggaatgaggttctcccttagtctttaggacttaaaccgcgtgtacgctgatgacttctgtgatatc

SEQ ID NO: 305 - DNA, 77 bp, Bradyrhizobium sp. AS23.2
  misc_feature (1)..(77): LGHM01000032.1/20467-20391 Bradyrhizobium sp. AS23.2 Bradyrhizobium_AS_23.2_c32, whole genome shotgun sequence
cacccagatggggatggagtcccccgacaaccgcccggtggtcgagactgtattgggctgatgactcctgcttgagg

SEQ ID NO: 306 - DNA, 65 bp, Tepidibacillus sp. Z9
  misc_feature (1)..(65): LSKU01000001.1/1852967-1852903 Tepidibacillus sp. Z9 scaffold00001, whole genome shotgun sequence
taaataatgggcgatggagttcgccttaaactgcctaatcataggctaatgactcctaccagaac

SEQ ID NO: 307 - DNA, 75 bp, Lactococcus lactis subsp. cremoris TIFN6
  misc_feature (1)..(75): ATBB01000155.1/387-313 Lactococcus lactis subsp. cremoris TIFN6 scaffold12.1_39, whole genome shotgun sequence
aataatgatgggtatggtgcacacccgaaaccgctttaagaataaaatcttaaaactaatggcgcctacaaacaa

SEQ ID NO: 308 - DNA, 62 bp, Paenibacillus wynnii strain DSM 18334
  misc_feature (1)..(62): JQCR01000003.1/1098358-1098297 Paenibacillus wynnii strain DSM 18334 unitig_3_1r, whole genome shotgun sequence
agttgataaggcgatggagttcgccaaaaccgccggtaacggctaatgactcctaccagcga

SEQ ID NO: 309 - DNA, 79 bp, Bifidobacterium angulatum DSM 20098
  misc_feature (1)..(79): GG663535.1/988748-988826 Bifidobacterium angulatum DSM 20098 genomic scaffold Scfld0, whole genome shotgun sequence
cttaccggtggcgatgggactcgcctggggcctgcaaggattcccgaaccgcaattccgctgatggttcctattgacgc

SEQ ID NO: 310 - DNA, 61 bp, Leptospirillum ferrodiazotrophum
  misc_feature (1)..(61): ACNP01000013.1/37301-37241 Leptospirillum ferrodiazotrophum UBAL3_4481_9, whole genome shotgun sequence
ccggcggatggcgatggggttcgcctaatcccgcatttcgggtgatgactcctaccatggg

SEQ ID NO: 311 - DNA, 80 bp, Nitrospirillum amazonense
  misc_feature (1)..(80): AFBX01000321.1/11509-11430 Nitrospirillum amazonense Y2 contig00386, whole genome shotgun sequence
gctgcgtccggcaatggatttctgcctggccgtctcacagccgaaccgccccatccggggctgatgattcctaccttcgg

SEQ ID NO: 312 - DNA, 62 bp, Thermophagus xiamenensis strain DSM 19012
  misc_feature (1)..(62): FONA01000033.1/2272-2211 Thermophagus xiamenensis strain DSM 19012 genome assembly, contig: Ga0131197_133
tttgtacagggcaatgaggtctgcctttaaccgccaaaatggctgatgacttctactttagt

SEQ ID NO: 313 - DNA, 82 bp, Butyricicoccus pullicaecorum 1.2
  misc_feature (1)..(82): KB976103.1/684369-684288 Butyricicoccus pullicaecorum 1.2 genomic scaffold acBRa-supercont1.1, whole genome shotgun sequence
aacagccgagggaatgaatgtctcccgcggcctttgcgccgaaaccgcttgaatgacgagagctgatgacttctgcaacgat

SEQ ID NO: 314 - DNA, 66 bp, Spirochaetes bacterium
  misc_feature (1)..(66): MIBH01000036.1/29669-29604 Spirochaetes bacterium RBG_13_51_14 RBG_13_scaffold_263, whole genome shotgun sequence
ctttttattggggatggagtcccccaaaaaacgccttttaaaaaggctgatgactcctaccgcttc

SEQ ID NO: 315 - DNA, 71 bp, Nitrospira sp. ST-bin5 254
  misc_feature (1)..(71): MSXN01000005.1/102347-102277 Nitrospira sp. ST-bin5 254, whole genome shotgun sequence
attccttacggtgatggggttcaccggaaccgcctgcggtctctacccaggctgataactcctacgcaccc

SEQ ID NO: 316 - DNA, 66 bp, Lactobacillus plantarum WCFS1
  misc_feature (1)..(66): AL935263.2/1741232-1741167 Lactobacillus plantarum WCFS1 complete genome
aagttaatcggcgatgacgttcgccacataataattgataatcaatttgatgacgtctactgtttg

SEQ ID NO: 317 - DNA, 63 bp, Serratia sp. M24T3
  misc_feature (1)..(63): AJHJ01000011.1/95451-95513 Serratia sp. M24T3 contig011, whole genome shotgun sequence
ccgttttctggagatgacattcctcccaaaccgccctgaccggctaatgatgtctacgcaatc

SEQ ID NO: 318 - DNA, 68 bp, Chryseobacterium indologenes NBRC 14944
  misc_feature (1)..(68): BAVL01000003.1/2472-2405 Chryseobacterium indologenes NBRC 14944 DNA, contig: CIN01S03
gtaccaaaaggaaatggtgttcttccttacccaaccgctttacagaagctgatgacgcctgattgaga

SEQ ID NO: 319 - DNA, 62 bp, Burkholderia sp. H160 ctg00372
  misc_feature (1)..(62): ABYL01000251.1/1837-1776 Burkholderia sp. H160 ctg00372, whole genome shotgun sequence
ttcgcggctggagatcgcattctccattaaccgcccctggggctgatgatgcctgctacgcc

SEQ ID NO: 320 - DNA, 63 bp, Bosea sp. 67-29
  misc_feature (1)..(63): MKSQ01000024.1/27769-27707 Bosea sp. 67-29 SCNpilot_expt_1000_bf_scaffold_559, whole genome shotgun sequence
tcaccgtatggggatggagtcccccgataaccgccctaaccggctgatgactcctacaagcgc

SEQ ID NO: 321 - DNA, 72 bp, Clostridiaceae bacterium
  misc_feature (1)..(72): LADT01000026.1/67639-67568 Clostridiaceae bacterium BRH_c20a BRHa_1003380, whole genome shotgun sequence
atatggataggcgatggagctcgcctttaaccgctaaatgtttgttaattagctaatggctcctactggtca

SEQ ID NO: 322 - DNA, 62 bp, Methylocystis bryophila strain S285
  misc_feature (1)..(62): CP019948.1/2037217-2037156 Methylocystis bryophila strain S285, complete genome
tgccatccaggggatggggtgcccccgtaaccgccgcaaaggctgatgactcctacttgaga

SEQ ID NO: 323 - DNA, 62 bp, Betaproteobacteria bacterium
  misc_feature (1)..(62): MERP01000018.1/5185-5246 Betaproteobacteria bacterium RIFCSPLOWO2_12_FULL_68_19 rifcsplowo2_12_scaffold_13509, whole genome shotgun sequence
ccgcggcagggagatggcattcctcctttaaccgccgcgaggctgatgatgcctatctgaca

SEQ ID NO: 324 - DNA, 60 bp, Lactobacillus camelliae DSM 22697
  misc_feature (1)..(60): AYZJ01000062.1/5414-5473 Lactobacillus camelliae DSM 22697 = JCM 13995 strain DSM 22697 NODE_98, whole genome shotgun sequence
aacatgataggcgaaggtgttcgccataaccgttattcaactaatgacacctagtttcgg

SEQ ID NO: 325 - DNA, 61 bp, Rubellimicrobium thermophilum DSM 16684
  misc_feature (1)..(61): KE557320.1/1289108-1289048 Rubellimicrobium thermophilum DSM 16684 genomic scaffold R1_scaffold2, whole genome shotgun sequence
gtccgcccgcgggatggggcttcccgacaaccgccttgtggctgatggctcctgctgcggg

SEQ ID NO: 326 - DNA, 66 bp, Enterococcus asini ATCC 700915
  misc_feature (1)..(66): KB946293.1/189807-189872 Enterococcus asini ATCC 700915 genomic scaffold acvKe-supercont1.3, whole genome shotgun sequence
ttgtgtaagagggatggtgctccctcctaactgctgagtgattcagctgatggcgcctgttataag

SEQ ID NO: 327 - DNA, 67 bp, Burkholderia sp. TJI49
  misc_feature (1)..(67): AEXE01000084.1/6900-6834 Burkholderia sp. TJI49 contig072, whole genome shotgun sequence
tttcgcgctggagatggcattcctcctcataaccgctggtcagccagctgatgatgcctacgcgttc

SEQ ID NO: 328 - DNA, 72 bp, Deltaproteobacteria bacterium
  misc_feature (1)..(72)
agtttattaggcgatgaagtccgccaaaaccgccccgctttcctgggctgggctgatgacttctgtccaacg

SEQ ID NO: 329 - DNA, 62 bp, Clostridia bacterium
  misc_feature (1)..(62): LOES01000122.1/6105-6044 Clostridia bacterium BRH_c25 BRHa_1003505, whole genome shotgun sequence
ataacaactggcgaaggagttcgccattaatcgtcctagtgactaatgactcctgtattaag

SEQ ID NO: 330 - DNA, 73 bp, Oxalobacter formigenes HOxBLS
  misc_feature (1)..(73): KI392031.1/1315201-1315129 Oxalobacter formigenes HOxBLS genomic scaffold supercont2.2, whole genome shotgun sequence
cagactcaaggtgatggtgttccacctttcccaaccgccacggttatttgtggctgatgacgcctgatttttt

SEQ ID NO: 331 - DNA, 62 bp, Listeria floridensis FSL S10-1187 c26
  misc_feature (1)..(62): AODF01000029.1/2014-2075 Listeria floridensis FSL S10-1187 c26, whole genome shotgun sequence
atctgtaacggcgatggagttcgccaaaaacgcgagtattcgctgatgactcctatttaaat

SEQ ID NO: 332 - DNA, 62 bp, Devosia sp. 67-54
  misc_feature (1)..(62): MKVA01000011.1/434077-434016 Devosia sp. 67-54 SCNpilot_cont_1000_bf_scaffold_9, whole genome shotgun sequence
gctgatgatggggatggggctccccgataaccgccgtcgtggctgataactcctgctgcaac

SEQ ID NO: 333 - DNA, 78 bp, Vagococcus teuberi strain DSM 21459
  misc_feature (1)..(78): CP017267.1/450598-450675 Vagococcus teuberi strain DSM 21459, complete genome
aacttaaacgggaatgatgttctcccatagttgaaatttaactaaaactgctaaatagctaatgacgtctacatgctt

SEQ ID NO: 334 - DNA, 61 bp, Burkholderia phymatum STM815
  misc_feature (1)..(61): CP001043.1/2012557-2012617 Burkholderia phymatum STM815 chromosome 1, complete sequence
gcgcgcgccggagatggcattctccttaaccgccctcgtggctgatgatgcctgcttcgcc

SEQ ID NO: 335 - DNA, 99 bp, Collimonas fungivorans Ter331
  misc_feature (1)..(99): CP002745.1/4925097-4924999 Collimonas fungivorans Ter331, complete genome
acacgcttcggagatggcattcctccctgaaccgccgcttctggccttgaatccttgcgggttcgccggccagacgcagctgatgatgcctacaagttc

SEQ ID NO: 336 - DNA, 63 bp, Yersinia ruckeri strain 37551
  misc_feature (1)..(63): JPFO01000020.1/242113-242051 Yersinia ruckeri strain 37551 YRO1b0000020, whole genome shotgun sequence
taaagcactggagatgacattcctccataaccgcccctcaaggctgatgatgtctacgtaacc

SEQ ID NO: 337 - DNA, 78 bp, Sphaerochaeta globosa str. Buddy
  misc_feature (1)..(78): CP002541.1/1343920-1343997 Sphaerochaeta globosa str. Buddy, complete genome
atctgaatgggcgatggggttcgccttcataatgaaaaccgcagagttctgaaagctgctgataactccagaaataaa

SEQ ID NO: 338 - DNA, 62 bp, Dickeya dadantii 3937
  misc_feature (1)..(62): CP002038.1/1376618-1376557 Dickeya dadantii 3937, complete genome
gccagtaacggagatgacattcctccataaccgcccttccggctgatgatgtctgcgagtcc

SEQ ID NO: 339 - DNA, 61 bp, Thermobaculum terrenum ATCC BAA-798
  misc_feature (1)..(62): CP001825.1/1684987-1685047 Thermobaculum terrenum ATCC BAA-798 chromosome 1, complete sequence
ataacataaggcgatgaggctcgccttgaaccgccgttgtgctgatggcctctacccttct

SEQ ID NO: 340 - DNA, 73 bp, Calothrix sp. HK-06
  misc_feature (1)..(73): MRCD01000046.1/30478-30406 Calothrix sp. HK-06 NIES-2101_Scaffold_46, whole genome shotgun sequence
tgatatctgggcaatggagcttgccattaaccgccattacatataataaaaggctgatagctcctactttcct

SEQ ID NO: 341 - DNA, 75 bp, Pantoea gaviniae strain LMG 25382
  misc_feature (1)..(75): MLFQ01000454.1/710-784 Pantoea gaviniae strain LMG 25382 Contig0454_, whole genome shotgun sequence
cggtgataaggtgatggcgtaccaccttgcccaaccgcgactccgcttgcgagcgctgatgacgcctgacacgac

SEQ ID NO: 342 - DNA, 66 bp, Enterococcus thailandicus strain F0711D
  misc_feature (1)..(66): LWMN01000010.1/106954-107019 Enterococcus thailandicus strain F0711D 46 Ent-16_S35_L001_001_2, whole genome shotgun sequence
ttatgtgtgagggatggtgctccctcctaaacgctgagtaaatcagctgatggcgcctattgtaaa

SEQ ID NO: 343 - DNA, 77 bp, Terrabacter sp. 28
  misc_feature (1)..(77): JYOE01000003.1/272616-272692 Terrabacter sp. 28 contig3, whole genome shotgun sequence
gtggtgctcggcgatggatcccgccaggtcacctcgagtgcccgaaccgccggccggctgatggttcctgtccgtgc

SEQ ID NO: 344 - DNA, 84 bp, Clostridiales bacterium KLE1615
  misc_feature (1)..(84): KV441297.1/76989-76906 Clostridiales bacterium KLE1615 genomic scaffold Scaffold133, whole genome shotgun sequence
atatgttttgggaatgaagttctcccattgatacattccttgtatcacaaaccgctggttaaggctgatgacttctgcgaattt

SEQ ID NO: 345 - DNA, 70 bp, OM182 bacterium BACL3
  misc_feature (1)..(70): LIDG01000339.1/243-312 OM182 bacterium BACL3 MAG-120619-bin32 contig04497_1_120619-bin32, whole genome shotgun sequence
taattaaaaggaaatggtgttcttccttgcccaaccgcttttaaaaaaagctgatgacgcctgattaaat

SEQ ID NO: 346 - DNA, 56 bp, Lactobacillus oryzae
  misc_feature (1)..(56): BBJM01000037.1/4461-4516 Lactobacillus oryzae DNA, contig: sequence37, strain: SG293
ttatcttatggcgatggtgctcgcctacgcgaaacgctgatggcgcctactctgtg

SEQ ID NO: 347 - DNA, 88 bp, Gammaproteobacteria bacterium MFB021
  misc_feature (1)..(88): JNVT01000097.1/26197-26284 Gammaproteobacteria bacterium MFB021 Contig-100, whole genome shotgun sequence
tggcagccgggagatggcattcctcccgcggcatgggccccgccgccccggccgcaaaccgcagcccgctgatgatgcctgccaacgc

SEQ ID NO: 348 - DNA, 71 bp, Burkholderia sp. TJI49
  misc_feature (1)..(71): AEXE01000084.1/24437-24507 Burkholderia sp. TJI49 contig072, whole genome shotgun sequence
tcgatctacggagatggcattctccgccaaccgccgcgccctcaggcccggctgatgatgcctgcagccgt

SEQ ID NO: 349 - DNA, 77 bp, Sphingomonas sp. Leaf339
  misc_feature (1)..(77): LMRS01000059.1/46491-46567 Sphingomonas sp. Leaf339 scaffold7.1, whole genome shotgun sequence
gtcgggcacggcgatggatttccgccgggccattcggccgaaccgccctcgcaagggccgatgattcctaccaggcg

SEQ ID NO: 350 - DNA, 65 bp, Nitrospirae bacterium
  misc_feature (1)..(65): MHEU01000028.1/21625-21561 Nitrospirae bacterium RIFCSPLOWO2_02_FULL_62_14 rifcsplowo2_02_scaffold_21280, whole genome shotgun sequence
agatacacaggggatggagtcccccgggtaaccgccctggccgggctgatgactcctacgctacc

SEQ ID NO: 351 - DNA, 72 bp, Clostridium sp. CAG:127
  misc_feature (1)..(72): HF993815.1/50413-50342 Clostridium sp. CAG:127 genomic scaffold, scf111
acagaaaaagggaatgaagttctccctcgggtaaccggaactgcttataaagctgatgacttctacgatatt

SEQ ID NO: 352 - DNA, 79 bp, Enterococcus sp. 9E7_DIV0242
  misc_feature (1)..(79): NGMM01000001.1/316799-316877 Enterococcus sp. 9E7_DIV0242 scaffold00001, whole genome shotgun sequence
agagcaatagggaatgaagttctccctagacagtgtatgtcaaaaccgcaattattttgctgatgacttctaccaccat

SEQ ID NO: 353 - DNA, 74 bp, Blautia sp. CAG:52
  misc_feature (1)..(74): FR883718.1/1287-1360 Blautia sp. CAG:52 genomic scaffold, scf144
atccagaacgggaatgaggttctcccacgatttttgatcgaaaccgccaaaaggctgatgacttctgtgcatgg

SEQ ID NO: 354 - DNA, 111 bp, Natrinema versiforme
  misc_feature (1)..(111): AOID01000048.1/66745-66635 Natrinema versiforme JCM 10478 contig_48, whole genome shotgun sequence
cagtatccgggcgatggggcccgcctgatccaaccgccggagaaacgccgacccgctggcatcgccgccggcagggtcgagcgtcggtcggctgacggtccctgcgaccag

SEQ ID NO: 355 - DNA, 63 bp, Rhizobiales bacterium 65-79
  misc_feature (1)..(63): MKRJ01000017.1/33766-33828 Rhizobiales bacterium 65-79 SCNpilot_cont_1000_bf_scaffold_222, whole genome shotgun sequence
cgttcaggcggggatggagtcccccgctaaccgcctttccaggctgatgactcctactgtcgg

SEQ ID NO: 356 - DNA, 77 bp, Rhizobium oryziradicis strain N19
  misc_feature (1)..(77): MKIM01000027.1/828078-828002 Rhizobium oryziradicis strain N19 scaffold3, whole genome shotgun sequence
tctcccatcggtaatggattctgcctggcatcaagccgaaccgcttccttgaagaagctgatgactcctactcaacg

SEQ ID NO: 357 - DNA, 59 bp, Clostridium disporicum strain 2789STDY5834856
  misc_feature (1)..(59): CYZX01000019.1/43096-43038 Clostridium disporicum strain 2789STDY5834856 genome assembly, contig: SCcontig000019
aataaataaggcgatggagttcgccataatcgcgtaaagctaatgactcctactctttt

SEQ ID NO: 358 - DNA, 76 bp, Xanthomonadaceae bacterium 3.5X
  misc_feature (1)..(76): KN196470.1/1239508-1239433 Xanthomonadaceae bacterium 3.5X genomic scaffold scaffold1, whole genome shotgun sequence
ggaggccggggagatggcatgcctcccgtccgccatgcggatgaaccgccccagggctgatgatgcctgttccgtc

SEQ ID NO: 359 - DNA, 89 bp, Lactobacillus perolens DSM 12744
  misc_feature (1)..(89): AZEC01000003.1/140411-140499 Lactobacillus perolens DSM 12744 Scaffold3, whole genome shotgun sequence
aagtaaataggcgatgacgttcgccagtggtgctgtatttaacagcacttcaaatattacactccgtaattgatgacgtctgcaatatt

SEQ ID NO: 360 - DNA, 86 bp, Williamsia sterculiae strain CPCC 203464
  misc_feature (1)..(86): FTNT01000006.1/163404-163489 Williamsia sterculiae strain CPCC 203464 genome assembly, contig: Ga0104459_106
tcagtctctggcgatggatctcgccggaccttgctgatctgagctgaggtcgaaccgccctctcggctgatagttcctactcgtcg

SEQ ID NO: 361 - DNA, 87 bp, Candidatus Melainabacteria bacterium
  misc_feature (1)..(87): MFRO01000022.1/66621-66535 Candidatus Melainabacteria bacterium RIFCSPLOWO2_12_FULL_35_11 rifcsplowo2_12_scaffold_2329, whole genome shotgun sequence
gaaattcctggcgatgaagctcgccttgtcttaagtaaaagacaaaaccactactaaagaagagtagttgatagcttctactgaaaa

SEQ ID NO: 362 - DNA, 63 bp, Sphingobacterium sp. ML3W
  misc_feature (1)..(63): CP009278.1/1755095-1755033 Sphingobacterium sp. ML3W, complete genome
cctaaataaggcaatgatgtctgccctaaaccgctttaagaagctgatgacgtctactttaga

SEQ ID NO: 363 - DNA, 63 bp, Sphingobacterium faecium PCAi_F2.5
  misc_feature (1)..(63): FUKX01000060.1/309916-309854 Sphingobacterium faecium PCAi_F2.5 genome assembly, contig: Scaffold3
gcttaataaggccatgatgtctgccctgaaccgcttgataaagctgatgacgtctactccgat

SEQ ID NO: 364 - DNA, 72 bp, Elusimicrobia bacterium
  misc_feature (1)..(72): MGUR01000059.1/3351-3280 Elusimicrobia bacterium RIFCSPLOWO2_01_FULL_59_12 rifcsplowo2_01_scaffold_75370, whole genome shotgun sequence
ctgctggacggcgatggggttcgccgctaaccgcctgaaagtcctctcgaggctgatgactcctgccaatcc

SEQ ID NO: 365 - DNA, 61 bp, Bradyrhizobiaceae bacterium SG-6C
  misc_feature (1)..(61): CM001195.1/1820945-1820885 Bradyrhizobiaceae bacterium SG-6C chromosome, whole genome shotgun sequence
aattttgatggggatggagtcccccgatacccgccggatggctgatgactcctaccgggcg

SEQ ID NO: 366 - DNA, 72 bp, Methanocella paludicola SANAE
  misc_feature (1)..(72): AP011532.1/2428555-2428484 Methanocella paludicola SANAE DNA, complete genome
acatacagcggcgatgaagctcgccgtggctcatggcaaaaccgccgcaaggctgatagcttctattttaaa

SEQ ID NO: 367 - DNA, 75 bp, Mycobacterium sp. NE-TNMC-100812
  misc_feature (1)..(75): MLQM01000022.1/24289-24363 Mycobacterium sp. NE-TNMC-100812 PROKKA_contig000022, whole genome shotgun sequence
acgagcaccggcgatggggcccgcccggaagtctgacttccgaaccgccgcaaggatgatggcctctgcgaacga

SEQ ID NO: 368 - DNA, 71 bp, Methanobrevibacter smithii ATCC 35061
  misc_feature (1)..(71): CP000678.1/1167738-1167808 Methanobrevibacter smithii ATCC 35061, complete genome
taataacttggtgatggggttcaccagaaacttattttcaaaccgcaattgctgataactcctatgttata

SEQ ID NO: 369 - DNA, 74 bp, Leptospirillum ferriphilum ML-04
  misc_feature (1)..(74): CP002919.1/1075339-1075412 Leptospirillum ferriphilum ML-04, complete genome
atgacgaggggtgatggagtccacctgaacggccctttttcagacgagaaagggatgatgactcctgtgagaga

SEQ ID NO: 370 - DNA, 60 bp, Peptococcaceae bacterium SCADC1_2_3
  misc_feature (1)..(60): JJNX02000059.1/399-458 Peptococcaceae bacterium SCADC1_2_3 contig_59, whole genome shotgun sequence
tttcgggatggcgatggagttcgccactaagtctgtaaggctgataactcctaccacttt

SEQ ID NO: 371 - DNA, 73 bp, Variovorax sp. PAMC 28711
  misc_feature (1)..(73): CP014517.1/1247441-1247513 Variovorax sp. PAMC 28711, complete genome
tttttcgacggagatggcattccttccgtgaaccgccctggcatcgcccggggctaatgatgcctacagacac

SEQ ID NO: 372 - DNA, 68 bp, Planctomycetes bacterium
  misc_feature (1)..(68): MHXU01000070.1/3359-3426 Planctomycetes bacterium GWC2_45_44 gwc2_scaffold_20600, whole genome shotgun sequence
aaatatataggcgatgaggttcgccaagtaactgcctttataaaaaggacgatgacctctaccaacaa

SEQ ID NO: 373 - DNA, 64 bp, Alphaproteobacteria bacterium 62-8
  misc_feature (1)..(64): MKRW01000012.1/13718-13781 Alphaproteobacteria bacterium 62-8 SCNpilot_cont_300_bf_scaffold_1308, whole genome shotgun sequence
gatggcgatggggatggggttcccccgaaaccgccctttccgggctgatgactcctgttatttc

SEQ ID NO: 374 - DNA, 64 bp, Photobacterium marinum strain AK15
  misc_feature (1)..(64): AMZO01000044.1/254-317 Photobacterium marinum strain AK15 contig44, whole genome shotgun sequence
ttcatgacgggtgatggagttccacctttaaccgctctactgagatgatgactcctgctgtagt

SEQ ID NO: 375 - DNA, 66 bp, Acetobacter persici strain TMW2.1084
  misc_feature (1)..(66): CP014687.1/2546985-2547050 Acetobacter persici strain TMW2.1084, complete genome
agaccgcaaggggatggggttccccctttaaccgcccttgcaagggctgatgactcctgccgtaac

SEQ ID NO: 376 - DNA, 77 bp, Methanobrevibacter arboriphilus JCM 13429 = DSM 1125
  misc_feature (1)..(77): JXMW01000015.1/11268-11192 Methanobrevibacter arboriphilus JCM 13429 = DSM 1125 strain DH1 MBBAR_15c, whole genome shotgun sequence
ttataataaggtgatgaggttcacctatttaaactgccagaatactattttttctggatgatgacctctactaataa

SEQ ID NO: 377 - DNA, 71 bp, Chryseobacterium gleum ATCC 35910
  misc_feature (1)..(71): GL379781.1/3872744-3872814 Chryseobacterium gleum ATCC 35910 genomic scaffold SCAFFOLD1, whole genome shotgun sequence
ttagtaaaaggaaatggtgttcttcctttcccaaccgctccaaaaaaagagctgatgacgcctgattaaat

SEQ ID NO: 378 - DNA, 66 bp, Candidatus Methanoregula boonei 6A8
  misc_feature (1)..(66): CP000780.1/914945-915010 Candidatus Methanoregula boonei 6A8, complete genome
tctgtcaggggcgatgaagtccgccgtaaccgccttaccctaaaggctgatgacttctgttttatg

SEQ ID NO: 379 - DNA, 77 bp, Sphingomonas sp. Ant20
  misc_feature (1)..(77): JRVI01000046.1/170562-170638 Sphingomonas sp. Ant20 Sphingomonas_Ant20_46, whole genome shotgun sequence
ctcgggcacggcgatggatttccgccgggccattcggccgaaccgccctcgcaagggccgatgattcctaccaggcg

SEQ ID NO: 380 - DNA, 61 bp, Nitrobacter sp. Nb-311A
  misc_feature (1)..(61): AAMY01000002.1/145285-145345 Nitrobacter sp. Nb-311A 1099473104484, whole genome shotgun sequence
gaaatcgatggggatggagttccccgatacccgccgcaaggctgatgactcctaccgggcg

SEQ ID NO: 381 - DNA, 73 bp, Flavobacterium rivuli WB 3.3-2 = DSM 21788
  misc_feature (1)..(73): JRLX01000004.1/77708-77780 Flavobacterium rivuli WB 3.3-2 = DSM 21788 strain WB 3.3-2 contig4, whole genome shotgun sequence
gtagtatatggcaatgatgtctgccctaaaccgcccgcaaattttatttgtagctgatgacgtctactttaat

SEQ ID NO: 382 - DNA, 62 bp, Thermanaerovibrio acidaminovorans DSM 6589
  misc_feature (1)..(62): CP001818.1/1537683-1537744 Thermanaerovibrio acidaminovorans DSM 6589, complete genome
caaagagagggtgatggggctcacccgaaactgcttttcaagctgatggcctctgcggacct

SEQ ID NO: 383 - DNA, 62 bp, Acidobacteriales bacterium
  misc_feature (1)..(62): MNDG01000032.1/6573-6634 Acidobacteriales bacterium 13_2_20CM_55_8 13_2_20cm_scaffold_3902, whole genome shotgun sequence
cctatgggtggcgatggagttcgccatcaaccgcccacagggctgatgactcctaccagttc

SEQ ID NO: 384 - DNA, 85 bp, Nostoc calcicola FACHB-389
  misc_feature (1)..(85): MRBZ01000073.1/36257-36173 Nostoc calcicola FACHB-389 FACHB-389_Scaffold_73, whole genome shotgun sequence
caaatcaatggcgatggagctcgccgaaaccgccttttcaacccgataaatcatcacttgaaaggctgatggctcctactttctt

SEQ ID NO: 385 - DNA, 63 bp, Citrobacter koseri ATCC BAA-895
  misc_feature (1)..(63): CP000822.1/1484941-1485003 Citrobacter koseri ATCC BAA-895, complete genome
ttttttacaggagatggcattcctcctcataaccgccctctggctgatgatgcctgcacattc

SEQ ID NO: 386 - DNA, 62 bp, Pseudomonas sp. MF4836
  misc_feature (1)..(62): MVOL01000018.1/15197-15136 Pseudomonas sp. MF4836 contig018, whole genome shotgun sequence
atcagatcaggagatggcattcctcctttaacggccttcgtgctgatgatgcctacgtgaac

SEQ ID NO: 387 - DNA, 73 bp, Pseudomonas floridensis strain GEV388
  misc_feature (1)..(73): MUIO01000009.1/15607-15679 Pseudomonas floridensis strain GEV388 GEV-388_contig_9, whole genome shotgun sequence
cggcgcattggagatggcattcctccattaaccaaccgctgcgcccgtagcagctgatgatgcctacagaaac

SEQ ID NO: 388 - DNA, 75 bp, Caldicellulosiruptor owensensis OL
  misc_feature (1)..(75): CP002216.1/2041037-2040963 Caldicellulosiruptor owensensis OL, complete genome
aaatatcagggcgatggagttcgccttaaagtgccacggggaatacccttgttggctgataactcctgtccgtat

SEQ ID NO: 389 - DNA, 68 bp, Elusimicrobia bacterium GWA2_69_24
  misc_feature (1)..(68): MGTY01000072.1/123-190 Elusimicrobia bacterium GWA2_69_24 gwa2_scaffold_3432, whole genome shotgun sequence
taggctcaaggcgatggagttcgcctgaaccgcctcgtccacccggggctgatgactcctaccaaaca

SEQ ID NO: 390 - DNA, 61 bp, Nitrobacter hamburgensis X14
  misc_feature (1)..(61): CP000319.1/237736-237676 Nitrobacter hamburgensis X14, complete genome
gacatcgatggggatggagttccccgatacccgccgcaaggctgatgactcctaccgggcg

SEQ ID NO: 391 - DNA, 76 bp, Vibrio ponticus
  misc_feature (1)..(76): BBMI01000017.1/94305-94230 Vibrio ponticus DNA, contig: contig00012_17, strain: JCM 19238
taatcacacggtgatggggtaccaccggaatcaaacgattcaaaccgcttttaatgctgatgactcctacagaaac

SEQ ID NO: 392 - DNA, 65 bp, Alicyclobacillus sp. RIFOXYA1_FULL_53_8
  misc_feature (1)..(65): MELW01000158.1/3682-3618 Alicyclobacillus sp. RIFOXYA1_FULL_53_8 rifoxya1_full_scaffold_2892, whole genome shotgun sequence
aaatgaatcggtgatggagctcaccttaaaccgccaacgtgttggctaatggctcctgcgaatgg

SEQ ID NO: 393 - DNA, 62 bp, Chloroflexus aurantiacus J-10-fl
  misc_feature (1)..(62): CP000909.1/429462-429523 Chloroflexus aurantiacus J-10-fl, complete genome
aatcgattgggtgatgaggctcaccctcaactgccattacggctgatagcctctacagggaa

SEQ ID NO: 394 - DNA, 71 bp, Stenotrophomonas sp. Leaf70
  misc_feature (1)..(71): LMLT01000001.1/571022-571092 Stenotrophomonas sp. Leaf70 contig_1, whole genome shotgun sequence
tacgtggtaggagatggcgttcctcctttaaccgcagcgatttcttagctgctgatgacgcctacagacac

SEQ ID NO: 395 - DNA, 65 bp, Flavobacterium beibuense F44-8
  misc_feature (1)..(65): JRLV01000009.1/149236-149300 Flavobacterium beibuense F44-8 contig10, whole genome shotgun sequence
tttggtactggcaatgatgtctgccttgaaccgcccttaactgggctgatggcgtctacagttac

SEQ ID NO: 396 - DNA, 71 bp, Armatimonadetes bacterium 55-13
  misc_feature (1)..(71): MKRX01000024.1/15032-14962 Armatimonadetes bacterium 55-13 SCNpilot_expt_500_bf_scaffold_558, whole genome shotgun sequence
ctattaatagggcatggagttcgccctacacaagaaccgcccaaagacgggctgatgactcctacggtggc

SEQ ID NO: 397 - DNA, 72 bp, Arc I group archaeon
  misc_feature (1)..(72): LNJC01000025.1/8487-8416 Arc I group archaeon BMIXfssc0709_Meth_Bin006 APG12_contig000025, whole genome shotgun sequence
attctctttggtgatgaagtccgccaaggccctagcctaaactgccttcaagctgatgacttcttttatcaa

SEQ ID NO: 398 - DNA, 68 bp, Vibrio ezurae NBRC 102218 DNA
  misc_feature (1)..(68): BATM01000007.1/13923-13990 Vibrio ezurae NBRC 102218 DNA, contig: VEZ01S07
aattgcacaggtgatggggttccacctacttaaccgccaaatcattggctgatgactcctactaaaat

SEQ ID NO: 399 - DNA, 61 bp, Betaproteobacteria bacterium
  misc_feature (1)..(61): MERA01000302.1/2780-2840 Betaproteobacteria bacterium RIFCSPLOWO2_02_FULL_65_24 rifcsplowo2_02_scaffold_64491, whole genome shotgun sequence
ccgcagcagggagatggcattctcccctaaccgccgcaaggctgatgatgcctactcgaga

SEQ ID NO: 400 - DNA, 71 bp, Sphingomonas sp. LH128
  misc_feature (1)..(71): ALVC01000192.1/11830-11760 Sphingomonas sp. LH128 Contig192, whole genome shotgun sequence
cgccggcaaggcgatggatttccgccgggcttcggccgaaccgccttcgggctgatgattcctacctgatg

SEQ ID NO: 401 - DNA, 60 bp, Clostridium intestinale URNW
  misc_feature (1)..(60): KI273145.1/1739300-1739359 Clostridium intestinale URNW genomic scaffold scaffold1, whole genome shotgun sequence
taatttataggtgatggagttcaccttaatcgcaatttagctaatgactcctacaggtcc

SEQ ID NO: 402 - DNA, 73 bp, Xylophilus sp. Leaf220; identical to SEQ ID NO: 371
  misc_feature (1)..(73): LMKO01000022.1/74417-74345 Xylophilus sp. Leaf220 contig_3, whole genome shotgun sequence

SEQ ID NO: 403 - DNA, 90 bp, Halomonadaceae bacterium
  misc_feature (1)..(90): LSBP01000002.1/235766-235677 Halomonadaceae bacterium T82-2 scaffold_1, whole genome shotgun sequence
tatcgcccgggagatggcatgcctcccggcggcacggtgtttccggcccgccaaaccaccgtactcacggttaatgatgcctgcgaggcg

SEQ ID NO: 404 - DNA, 78 bp, Mycobacterium heraklionense strain Davo
  misc_feature (1)..(78): LDPO01000008.1/6838-6915 Mycobacterium heraklionense strain Davo contig_8, whole genome shotgun sequence
ctggggacgcgcgatggatctccgccggggcacttgagtgcccaaaccgccgttctggctgatggttcctgcccggac

SEQ ID NO: 405 - DNA, 66 bp, Acidocella sp. MX-AZ02
  misc_feature (1)..(66): JH976207.1/895295-895360 Acidocella sp. MX-AZ02 genomic scaffold Contig1, whole genome shotgun sequence
cagaggcacggggatggagtccccccaaaaccgctccttcggggagctgatgactcctgcacggat

SEQ ID NO: 406 - DNA, 66 bp, Collimonas arenae strain Cal35
  misc_feature (1)..(66): CP009962.1/5381437-5381372 Collimonas arenae strain Cal35, complete genome
tgagaagcgggagatggcatgcctccccgaaccgccgcgcaagcagctgatgatgcctacaagttc

SEQ ID NO: 407 - DNA, 64 bp, Chromobacterium aquaticum strain CC-SEYA-1
  misc_feature (1)..(64): MQZY01000028.1/60641-60578 Chromobacterium aquaticum strain CC-SEYA-1 NODE_28_length_65912_cov_30.846569, whole genome shotgun sequence
gcttcagatggagatggcattcctccgccaaccgcccgcaagggctgatgatgcctacagcgtt

SEQ ID NO: 408 - DNA, 60 bp, Rhodospirillum rubrum ATCC 11170
  misc_feature (1)..(60): CP000230.1/293075-293134 Rhodospirillum rubrum ATCC 11170, complete genome
gacgatactgggaatggggtctcccgaaaccgccgaaaggctgatgactcctaccgcgta

SEQ ID NO: 409 - DNA, 93 bp, Lactobacillus harbinensis DSM 16991 NODE_11
  misc_feature (1)..(93): AZFW01000008.1/50439-50347 Lactobacillus harbinensis DSM 16991 NODE_11, whole genome shotgun sequence
aagtgaataggcgatgacgttcgccaggggtaagcaggttttctgcataccgcacaaacattacagtatgtaattaatgacgcctacaatatt

SEQ ID NO: 410 - DNA, 64 bp, Rhodospirillales bacterium
  misc_feature (1)..(64): MHZZ01000169.1/3615-3678 Rhodospirillales bacterium RIFCSPLOWO2_01_FULL_65_14 rifcsplowo2_01_scaffold_42705, whole genome shotgun sequence
ccccgcgccggtgatgaagtccaccgcaaccgctccttccggggctgatgacttctggcagaac

SEQ ID NO: 411 - DNA, 62 bp, Mycobacterium sp. E2978
  misc_feature (1)..(62): LZIT01000178.1/31099-31160 Mycobacterium sp. E2978 contig_259, whole genome shotgun sequence
tcgcggataggcgatgaagctcgccgtaaccgccgcacctggctgatggcttctacccgtgc

SEQ ID NO: 412 - DNA, 64 bp, Gluconobacter oxydans H24
  misc_feature (1)..(64): CP003926.1/1806942-1807005 Gluconobacter oxydans H24, complete genome
attcggataggagatggggttcctccttttaaccgccgcatcggctgatgactcctggcatgaa

SEQ ID NO: 413 - DNA, 64 bp, Photobacterium gaetbulicola Gung47
  misc_feature (1)..(64): CP005974.1/365233-365296 Photobacterium gaetbulicola Gung47 chromosome 2, complete sequence
gggatgacgggtgatggagttccacctttaaccgctcaaccgagataatgactcctgctgtagt

SEQ ID NO: 414 - DNA, 77 bp, Pantoea wallisii strain LMG 26277
  misc_feature (1)..(77): MLFS01000010.1/32071-32147 Pantoea wallisii strain LMG 26277 Contig0010_, whole genome shotgun sequence
tgcgcctgaggtgatggcgtgccaccttacccaaccgccgttctggtaaccagacggctgatgacgcctgacaacac

SEQ ID NO: 415 - DNA, 61 bp, Thermoanaerobacterium saccharolyticum JW/SL-YS485
  misc_feature (1)..(61): CP003184.1/651765-651825 Thermoanaerobacterium saccharolyticum JW/SL-YS485, complete genome
attaagattggtgatggagctcaccattaaatgcgatgatgctgatggctcctattgggta

SEQ ID NO: 416 - DNA, 68 bp, Halococcus saccharolyticus DSM 5350
  misc_feature (1)..(68): AOMD01000005.1/1612-1545 Halococcus saccharolyticus DSM 5350 contig_5, whole genome shotgun sequence
acggtatcgggcgatggagtccgcctgccccaaccgctggttacccagctgatgactccttttcggag

SEQ ID NO: 417 - DNA, 62 bp, Pseudonocardia sp. AL041005-10
  misc_feature (1)..(62): CP011862.1/1288559-1288498 Pseudonocardia sp. AL041005-10, complete genome
gccaccgatggcgatggggctcgccgagaaccgcaccgcgtgctgatagctcctaccgacga

SEQ ID NO: 418 - DNA, 63 bp, Mesorhizobium sp. 65-26
  misc_feature (1)..(63): MKVL01000010.1/455530-455592 Mesorhizobium sp. 65-26 SCNpilot_cont_1000_bf_scaffold_20, whole genome shotgun sequence
ggccccgatgggaatggggttctcccgaaaccgccagtgatggctgatgactcctgccgcgaa

SEQ ID NO: 419 - DNA, 62 bp, Thermoplasmatales archaeon Gpl AMDU5_GPLC00005
  misc_feature (1)..(62): ATDV01000005.1/32087-32148 Thermoplasmatales archaeon Gpl AMDU5_GPLC00005, whole genome shotgun sequence
ttcaagaaaggctatgacgttagcctttaagcgccctccgggctgataacgtctgatcttta

SEQ ID NO: 420 - DNA, 71 bp, Novosphingobium sp. ST904; identical to SEQ ID NO: 400
  misc_feature (1)..(71): LGJH01000114.1/2787-2717 Novosphingobium sp. ST904 contig_53, whole genome shotgun sequence

SEQ ID NO: 421 - DNA, 64 bp, Acidithiobacillus ferrooxidans ATCC 23270
  misc_feature (1)..(64): CP001219.1/2606884-2606947 Acidithiobacillus ferrooxidans ATCC 23270, complete genome
aaaacgtgtggcgatggagtccgcccaataaccgcctttataggctgatgactgctactgatcc

SEQ ID NO: 422 - DNA, 64 bp, Geosporobacter ferrireducens strain IRF9
  misc_feature (1)..(64): CP017269.1/1008507-1008444 Geosporobacter ferrireducens strain IRF9, complete genome
aatggtaaaggtgatggagctcaccataaacattgctgcggcaattaatggctcctactaagga

SEQ ID NO: 423 - DNA, 70 bp, Thiomonas bhubaneswarensis strain DSM 18181
  misc_feature (1)..(70): CYHF01000012.1/45411-45480 Thiomonas bhubaneswarensis strain DSM 18181 genome assembly, contig: Ga0061069_112
aacaaatacggcgatggagttcgccaaaaccgcgcggggctgtcccgtagctaatgactcctacctgccg

SEQ ID NO: 424 - DNA, 64 bp, Lactobacillus acetotolerans
  misc_feature (1)..(64): AP014808.1/1618185-1618122 Lactobacillus acetotolerans DNA, complete genome, strain: NBRC 13120
aattaaataggtgatgacgttcaccaataataaatgggcaaattctaatgacgtctactattac

SEQ ID NO: 425 - DNA, 78 bp, Mycobacterium sp. NE-TNMC-100812
  misc_feature (1)..(78): MLQM01000022.1/24196-24119 Mycobacterium sp. NE-TNMC-100812 PROKKA_contig000022, whole genome shotgun sequence
tggcggccaggcgatggatctccgccggggtgtgtgcacacccaaaccgccgaccgggctgatggttcctgctggaac

SEQ ID NO: 426 - DNA, 73 bp, Niastella populi strain 208
  misc_feature (1)..(73): LWBP01000234.1/1623-1551 Niastella populi strain 208 contig71, whole genome shotgun sequence
actcacaaaggaaatggtgtcttcctatttgaaccgtccgatacacttcgcgactgatggcgcctgcaaatag

SEQ ID NO: 427 - DNA, 62 bp, Bacillus vireti LMG 21834
  misc_feature (1)..(62): ALAN01000099.1/12847-12908 Bacillus vireti LMG 21834 contig99, whole genome shotgun sequence
atgataaaaggcgatggagttcgccatcaaccgtctttgtgactaatgactcctaccagtgg

SEQ ID NO: 428 - DNA, 77 bp, Omnitrophica bacterium
  misc_feature (1)..(77): MHFJ01000058.1/3061-3137 Omnitrophica bacterium RIFCSPHIGHO2_02_FULL_63_14 rifcsphigho2_02_scaffold_4915, whole genome shotgun sequence
ccacgtaagggcgatggagttcgccggatagtcctcgtgctttttagcgatgtgggaatgatgactcctaccgagaa

SEQ ID NO: 429 - DNA, 80 bp, Roseburia sp. CAG:303
  misc_feature (1)..(80): FR900143.1/8193-8114 Roseburia sp. CAG:303 genomic scaffold, scf291
atattataagggaatgaagttctcccctaatgtaataaacattaaaaccgcttatttaagctgatgacttctgcgtaata

SEQ ID NO: 430 - DNA, 62 bp, Macellibacteroides sp. HH-ZS
  misc_feature (1)..(62): LZEK01000001.1/154640-154701 Macellibacteroides sp. HH-ZS contig_00001, whole genome shotgun sequence
agaaaatttggcaatggaatctgcccgaaaccgcccaaaaggctgatgatacctacctaact

SEQ ID NO: 431 - DNA, 80 bp, Rhizobium oryzae strain 1.7048
  misc_feature (1)..(80): MKIP01000044.1/4442-4521 Rhizobium oryzae strain 1.7048 scaffold18, whole genome shotgun sequence
caagtttccggtaatggattctgcctggccatggtggccgaaccgcttcgcaggatgaagctgatgactcctactcaact

SEQ ID NO: 432 - DNA, 76 bp, Nitrosomonas europaea ATCC 19718
  misc_feature (1)..(76): AL954747.1/1756266-1756341 Nitrosomonas europaea ATCC 19718, complete genome
tgaagataaggagatggtgttcctccttttgaagaaaccgcagccgtttagcgctgctgatgacgcctacaggacc

SEQ ID NO: 433 - DNA, 62 bp, Elusimicrobia bacterium
  misc_feature (1)..(62): MGTT01000015.1/119197-119258 Elusimicrobia bacterium GWA2_56_46 gwa2_scaffold_209, whole genome shotgun sequence
ggatataccggcgatggggttcgccataaaccgcctcaacggctgatgactcctataatcgc

SEQ ID NO: 434 - DNA, 67 bp, Delftia acidovorans SPH-1
  misc_feature (1)..(67): CP000884.1/1926512-1926446 Delftia acidovorans SPH-1, complete genome
gcagcgcaaagagatggcgtgcctctaaaaccgccgcactagtgcggctgatgacgcctacagaacc

SEQ ID NO: 435 - DNA, 63 bp, Alicyclobacillus acidoterrestris ATCC 49025
  misc_feature (1)..(63): AURB01000182.1/9519-9581 Alicyclobacillus acidoterrestris ATCC 49025 contig_76, whole genome shotgun sequence
aatcgcatcggtgatggagctcaccattaaccgcccgtaagggataatggctcctgcaaggaa

SEQ ID NO: 436 - DNA, 72 bp, Candidatus Fraserbacteria bacterium
  misc_feature (1)..(72): MFGX01000109.1/22374-22303 Candidatus Fraserbacteria bacterium RBG_16_55_9 RBG_16_scaffold_6090, whole genome shotgun sequence
ggcagaaatggcgatggagttcgctataaccactgctcggcagttggagcagttgataactcctacctcgtc

SEQ ID NO: 437 - DNA, 60 bp, Bacillus thermozeamaize isolate
  misc_feature (1)..(60): LZRT01000091.1/1028-1087 Bacillus thermozeamaize isolate ZCTH02-B2 BIN02_NODE49710855993, whole genome shotgun sequence
cgcgaaataggcgatggagttcgccataaccgcctgacggctgatgactcctaccgatac

SEQ ID NO: 438 - DNA, 78 bp, Novosphingobium sp. FSW06-99
  misc_feature (1)..(78): KQ954263.1/126366-126289 Novosphingobium sp. FSW06-99 genomic scaffold PRJNA299315_s013, whole genome shotgun sequence
ggcgcgcccggcgatggatttccgccgggcgctatgccgaaccacccgttttttcgggttgatgattcctacctttgg

SEQ ID NO: 439 - DNA, 69 bp, Euryarchaeota archaeon 55_53
  misc_feature (1)..(69): LGEW01000001.1/140405-140473 Euryarchaeota archaeon 55_53 PW_scaffold_0, whole genome shotgun sequence
gtgtgtatgggcgatgaggctcgccccaaccgccccacatcccatggggatgatggcctcttttatgag

SEQ ID NO: 440 - DNA, 60 bp, Brevibacillus laterosporus LMG 15441
  misc_feature (1)..(60): CP007806.1/3317303-3317244 Brevibacillus laterosporus LMG 15441, complete genome
gtaaatagaggcgatggagttcgccctaagcgccaataggctaatgactcctaccagtaa

SEQ ID NO: 441 - DNA, 64 bp, Sodalis sp. TME1
  misc_feature (1)..(64): MNBX01000082.1/9029-8966 Sodalis sp. TME1 V4_final_sodalis.fa.Contig82, whole genome shotgun sequence
gacccttcaggagatgacattcctccttataaccgccgttctggctgatgatgtctacgttcgc

SEQ ID NO: 442 - DNA, 71 bp, Niastella yeongjuensis strain 17621
  misc_feature (1)..(71): LVXG01000032.1/37818-37748 Niastella yeongjuensis strain 17621 contig38, whole genome shotgun sequence
tacgcgcaaggaaatggtgtcttcctacttaaccgtccgcctctggcgagactgatggcgcctacaaatac

SEQ ID NO: 443 - DNA, 73 bp, Firmicutes bacterium CAG:308
  misc_feature (1)..(73): FR894597.1/5344-5272 Firmicutes bacterium CAG:308 genomic scaffold, scf43
cttctttgtggaaatgaagttcttccatgggataacctaaaccgcttattaagctgatgacttctacgagttt

SEQ ID NO: 444 - DNA, 79 bp, Rhodovulum sp. PH10
  misc_feature (1)..(79): AKZI01000012.1/7720-7798 Rhodovulum sp. PH10 contig12, whole genome shotgun sequence
tcgcccgatggggatggagtcccccgacaaccgcctcgcccggtcgtccggttccgaggctgacgactcctgccgcgcc

SEQ ID NO: 445 - DNA, 69 bp, Candidatus Schekmanbacteria bacterium
  misc_feature (1)..(69): MGDE01000163.1/2906-2838 Candidatus Schekmanbacteria bacterium RBG_16_38_10 RBG_16_scaffold_45780, whole genome shotgun sequence
attagaaacggcgatggagtttgcctataactgcttacaaaaattgaggctgataactcctgctaaagg

SEQ ID NO: 446 - DNA, 61 bp, Caldilinea aerophila DSM 14535
  misc_feature (1)..(61): AP012337.1/2643146-2643086 Caldilinea aerophila DSM 14535 = NBRC 104270 DNA, complete genome
atcgattcaggcgatgaggctcgccctgaactgccgtttggctgatagcctctacggagaa

SEQ ID NO: 447 - DNA, 67 bp, Burkholderia sp. TJI49
  misc_feature (1)..(67): AEXE01000084.1/9332-9398 Burkholderia sp. TJI49 contig072, whole genome shotgun sequence
tctcgccatggagatggcattctccaaaaccgctcaagattgatgagccgatgatgcctacgacccg

SEQ ID NO: 448 - DNA, 63 bp, Sphingobacterium sp. IITKGP-BTPF85
  misc_feature (1)..(63): ASZT02000005.1/28896-28958 Sphingobacterium sp. IITKGP-BTPF85 Sphingobacterium_sp_IITKGP-BTPF85_Contig_00005, whole genome shotgun sequence
ctatgttaaggcaatgatgtctgccactaaccgctttaatgagctgatgacgtctacttttgc

SEQ ID NO: 449 - DNA, 69 bp, Deltaproteobacteria bacterium
  misc_feature (1)..(69): MGSY01000056.1/1894-1962 Deltaproteobacteria bacterium RIFOXYB2_FULL_66_7 rifoxyb2_full_scaffold_12479_curated, whole genome shotgun sequence
tggaatcccggcgatggagttcgccgtgaaatgcctgtgtcgatagaggctgatgactcctgcccgaca

SEQ ID NO: 450 - DNA, 91 bp, Rhodanobacter sp. C06
  misc_feature (1)..(91): MUNP01000040.1/35704-35794 Rhodanobacter sp. C06 NODE_18_length_93590_cov_8.59036_ID_35, whole genome shotgun sequence
atgcatgagggagatggcatgcctcccgctccagccatggagcgaaccgccgaagtgcagccgcaccgacgctaatgatgcctgcaccacc

SEQ ID NO: 451 - DNA, 60 bp, Sphingomonas sp. 67-41
  misc_feature (1)..(60): MKWJ01000020.1/46647-46588 Sphingomonas sp. 67-41 SCNpilot_cont_300_bf_scaffold_301, whole genome shotgun sequence
tcgctggatggggatggagtcccccataaccgccgacaggctgatgacccctactgcgtc

SEQ ID NO: 452 - DNA, 60 bp, Ochrobactrum intermedium 229E
  misc_feature (1)..(60): ASXJ01000196.1/5605-5664 Ochrobactrum intermedium 229E Contig269, whole genome shotgun sequence
atgggaatgggggggttctcccgaaactgccagcaattggctgatgactcctgcttgaat

SEQ ID NO: 453 - DNA, 65 bp, Lactobacillus casei ATCC 334
  misc_feature (1)..(65): CP000423.1/2430592-2430656 Lactobacillus casei ATCC 334, complete genome
agaagaacaggcgatgatgttcgccgcaaatgattgtgtagcaatctgatgacgtctactgaaac

SEQ ID NO: 454 - DNA, 60 bp, Clostridium homopropionicum DSM 5847
  misc_feature (1)..(60): LHUR01000005.1/89231-89172 Clostridium homopropionicum DSM 5847 CLHOM_contig000009, whole genome shotgun sequence
attaatataggtgatggagtttaccttaactgctataaagctaatgactcctacaagtaa

SEQ ID NO: 455 - DNA, 61 bp, Anaerolineae bacterium
  misc_feature (1)..(61): MNXJ01000057.1/171770-171830 Anaerolineae bacterium CG2_30_57_67 cg2_3.0_scaffold_15_c, whole genome shotgun sequence
actcttcctggcgatgaggctcgcccaaaccgtcttaacgactgatagcctctaccgaaac

SEQ ID NO: 456 - DNA, 75 bp, Humibacillus sp. DSM 29435
  misc_feature (1)..(75): MAST01000001.1/449973-449899 Humibacillus sp. DSM 29435 contig1, whole genome shotgun sequence
cgcaaagcaggtgatggatcccacctgagcgacagcgcccaaaccgccctaccggctgatggttcctaccgaaac

SEQ ID NO: 457 - DNA, 67 bp, Fulvimarina manganoxydans strain CGMCC
  misc_feature (1)..(67): FWXR01000008.1/90116-90050 Fulvimarina manganoxydans strain CGMCC 1.10972 genome assembly, contig: Ga0171588_108
atgatggatggggatggagtcccccgataaccgcctcgtcttcgaggctgatggctcctaccgcacg

SEQ ID NO: 458 - DNA, 76 bp, Verrucomicrobia bacterium
  misc_feature (1)..(76): MNDH01000070.1/19596-19671 Verrucomicrobia bacterium 13_2_20CM_2_54_15_9cls 13_2_20cm_2_scaffold_933, whole genome shotgun sequence
tccggcaacggcaatggagtttgccttcctaggtaaaactgggaaaaccgcgtgagctaatgactccttccaagcg

SEQ ID NO: 459 - DNA, 61 bp, Serratia sp. ATCC 39006
  misc_feature (1)..(61): AWXH01000002.1/1713938-1713878 Serratia sp. ATCC 39006 ctg2, whole genome shotgun sequence
accagtaacggagatgacattcctccataaccgccttccggctaatgatgtctacgagctc

SEQ ID NO: 460 - DNA, 63 bp, Pedobacter ginsenosidimutans strain KACC 14530
  misc_feature (1)..(63): LMZQ01000003.1/592572-592634 Pedobacter ginsenosidimutans strain KACC 14530 contig03, whole genome shotgun sequence
tggaacaatggcgatggagtaccgccaaaaccgcccaaacaggctgatgactcctacgatttt

SEQ ID NO: 461 - DNA, 65 bp, Sphaerochaeta pleomorpha str. Grapes
  misc_feature (1)..(65): CP003155.1/2504807-2504743 Sphaerochaeta pleomorpha str. Grapes, complete genome
atagtcactggtggtggagttcgccgttaaccgctgttgtcacagccaatgactcctgtataaga

SEQ ID NO: 462 - DNA, 61 bp, Planctomycetes bacterium
  misc_feature (1)..(61): MHYY01000014.1/1131-1071 Planctomycetes bacterium RIFCSPLOWO2_12_38_17 rifcsplowo2_12_sub10_scaffold_1193, whole genome shotgun sequence
attttaattggtgatggagttcgcctttaattgctaaatagctgataactcctattgaagc

SEQ ID NO: 463 - DNA, 70 bp, Echinicola vietnamensis DSM 17526
  misc_feature (1)..(70): CP003346.1/1855847-1855916 Echinicola vietnamensis DSM 17526, complete genome
atggtacaaggtgatggggtgccacctataaccgctctgatttttcagcgctgatgactcctgcttcgac

SEQ ID NO: 464 - DNA, 79 bp, Leptospirillum ferrooxidans C2-3
  misc_feature (1)..(79): AP012342.1/1504277-1504355 Leptospirillum ferrooxidans C2-3 DNA, complete genome
cgaatcatgggcgatggggttcgcctgaacggcagcggtgtttgatatgacaccggatgatgatgacccctactttaaa

SEQ ID NO: 465 - DNA, 105 bp, Rhodanobacter spathiphylli B39
  misc_feature (1)..(105): AJXT01000008.1/99215-99319 Rhodanobacter spathiphylli B39 contig008, whole genome shotgun sequence
ttcgccatgggagatggcatgcctcccgtcccggaatgctcgctccccccaggacaaaccgcttctcgcgctcctcgtgttgaagttgatgatgcctgctccccc

SEQ ID NO: 466 - DNA, 85 bp, Sulfobacillus thermosulfidooxidans strain ZBY
  misc_feature (1)..(85): MDZE01000018.1/1522-1606 Sulfobacillus thermosulfidooxidans strain ZBY contig3, whole genome shotgun sequence
taaaatcattgcaatggagttctgctctcttttggttgtgaccaaaagaaaaactgtccccaggactaatgactcctacccatat

SEQ ID NO: 467 - DNA, 78 bp, Thiomonas intermedia K12
  misc_feature (1)..(78): CP002021.1/1838401-1838324 Thiomonas intermedia K12, complete genome
tcaacaaacggcgatggagttcgccgtgcaattgcctcaataggggtttcgccccaggctgatgactcctacccatgt

SEQ ID NO: 468 - DNA, 63 bp, Methanothermobacter thermautotrophicus str. Delta H
  misc_feature (1)..(63): AE000666.1/688929-688867 Methanothermobacter thermautotrophicus str. Delta H, complete genome
catcctgcaggtgatggagtccacctttaaccgctttttctggctgatgactcctgcataata

SEQ ID NO: 469 - DNA, 78 bp, Acetobacter aceti NBRC 14818
  misc_feature (1)..(78): BAMU01000018.1/172763-172686 Acetobacter aceti NBRC 14818 DNA, contig: Abac_018
gacccatcaggcaatggattctgccggacttccctggaagtcgaaccgcccgtcagggctgatgattcctacctcgct

SEQ ID NO: 470 - DNA, 63 bp, Serratia proteamaculans 568
  misc_feature (1)..(63): CP000826.1/1310091-1310029 Serratia proteamaculans 568, complete genome
tcgaacgacggagatgacattcctccttaaccgccttcacgggctgatgatgtctacgtaacc

SEQ ID NO: 471 - DNA, 68 bp, Acinetobacter gerneri DSM 14967
  misc_feature (1)..(68): KB849514.1/275-208 Acinetobacter gerneri DSM 14967 = CIP 107464 genomic scaffold acLZs-supercont1.1, whole genome shotgun sequence
cagcttaaaggagatggctatcctccttatacaaaccgccaattctggctgatgatacctacgtttcc

SEQ ID NO: 472 - DNA, 105 bp, Burkholderia ubonensis strain MSMB782WGS
  misc_feature (1)..(105): LPLU01000048.1/36118-36222 Burkholderia ubonensis strain MSMB782WGS MSMB782WGS_26, whole genome shotgun sequence
gcgcgcttcggagatggcatgcctccccggggtccgggcttgctcgccacgagcacgcacaggccctcaaccgccggtcgtccggctgatgatgcctgcgcattc

SEQ ID NO: 473 - DNA, 65 bp, Zunongwangia atlantica 22II14-10F7
  misc_feature (1)..(65): ARYN01000004.1/81966-81902 Zunongwangia atlantica 22II14-10F7 contig4, whole genome shotgun sequence
aagaaatacggcaatgaggtctgccttaaaccgttccacctggagctaatgacatctacctttaa

SEQ ID NO: 474 - DNA, 77 bp, Agrobacterium albertimagni AOL15
  misc_feature (1)..(77): ALJF01000010.1/188103-188179 Agrobacterium albertimagni AOL15 Contig_10, whole genome shotgun sequence
gttttgtacggtaatggattctgccgggcatcaagccaaaccgcttccccgatgaagctgatgactcctactcagcg

SEQ ID NO: 475 - DNA, 83 bp, Chloroflexi bacterium
  misc_feature (1)..(83): MGNT01000094.1/1589-1671 Chloroflexi bacterium RBG_16_57_8 RBG_16_scaffold_30472, whole genome shotgun sequence
ctcatcattggcgatgaagctcgcccgaggatattaccagcttcctgaaccgccccaaccaggctgatagcttctactggccc

SEQ ID NO: 476 - DNA, 75 bp, Mycobacterium marinum M
  misc_feature (1)..(75): CP000854.1/4256142-4256216 Mycobacterium marinum M, complete genome
actagcagcggcgatggggctcgccaggaagctcgacttctgaaccgccagccggctgatggcacctgcgaacaa

SEQ ID NO: 477 - DNA, 74 bp, Clostridium sp. CAG:277
  misc_feature (1)..(74): FR900948.1/41495-41422 Clostridium sp. CAG:277 genomic scaffold, scf100
tgcagaaaagggaatgaagttctcccccgatttgattcgaaaccgctttataagctgatgacttctgtgcttca

SEQ ID NO: 478 - DNA, 62 bp, Synergistes sp. 3_1_syn1
  misc_feature (1)..(62): JH414691.1/284832-284771 Synergistes sp. 3_1_syn1 genomic scaffold supercont1.2, whole genome shotgun sequence
gcatacgagggcgatggagttcgcccgaaattcgtttttacgatgatgactcctgtccaaag

SEQ ID NO: 479 - DNA, 62 bp, Paraburkholderia terricola strain LMG 20594
  misc_feature (1)..(62): FRAB01000019.1/15466-15527 Paraburkholderia terricola strain LMG 20594 genome assembly, contig: Ga0075244_1019
ttgcgcgctggaaatggcattctcccttaaccgccgtggcggctgatgatgcctgcttcgcc

SEQ ID NO: 480 - DNA, 76 bp, Candidatus Methanoperedens nitroreducens strain ANME-2d
  misc_feature (1)..(76): JMIY01000007.1/448709-448634 Candidatus Methanoperedens nitroreducens strain ANME-2d ANME2D_Contig_7.7, whole genome shotgun sequence
aggaaatctggcgatgaggttcgccttggtatttacctaaactgtctcattcgagactgataacttctattttaag

SEQ ID NO: 481 - DNA, 68 bp, Chryseobacterium gleum ATCC 35910
  misc_feature (1)..(68): GL379781.1/3119783-3119850 Chryseobacterium gleum ATCC 35910 genomic scaffold SCAFFOLD1, whole genome shotgun sequence
tatcaaaaaggaaatggtgttcttccttacccaaccgctttacaaaagctgatgacgcctgattaaaa

SEQ ID NO: 482 - DNA, 62 bp, Mycobacterium sp. NE-TNMC-100812
  misc_feature (1)..(62): MLQM01000022.1/22919-22858 Mycobacterium sp. NE-TNMC-100812 PROKKA_contig000022, whole genome shotgun sequence
ttccgactaggcgatgaggctcgccgtaaccgccgcacctggctaatggcctctaccgaatg

SEQ ID NO: 483 - DNA, 62 bp, Desulfovibrio sp. 6_1_46AFAA
  misc_feature (1)..(62): JH114303.1/128052-128113 Desulfovibrio sp. 6_1_46AFAA genomic scaffold supercont1.4, whole genome shotgun sequence
tatctttacggggatggagtcccccttgaaccgcatgtattgctgatgactcctgcctgacg

SEQ ID NO: 484 - DNA, 71 bp, Frateuria sp. Soil773
  misc_feature (1)..(71): LMSL01000040.1/129165-129095 Frateuria sp. Soil773 contig_8, whole genome shotgun sequence
tcgaaccagggagatggcattcctcccggaacagaagtaaccgccgcaaggctaatgatgcctaccaaacg

SEQ ID NO: 485 - DNA, 117 bp, Selenihalanaerobacter shriftii strain ATCC BAA-73
  misc_feature (1)..(117): FUWM01000003.1/189103-188987 Selenihalanaerobacter shriftii strain ATCC BAA-73 genome assembly, contig: EI55DRAFT_scaffold00001.1
aaaaaaataggtgatgaagctcacctctataactgaaaaacaaatataaattattaagtttatattttaaaatcagttaagaaactgtctatataggctaatggcttctactttcta

SEQ ID NO: 486 - DNA, 66 bp, Candidatus Rokubacteria bacterium
  misc_feature (1)..(66): MGCA01000107.1/222-157 Candidatus Rokubacteria bacterium RIFCSPHIGHO2_02_FULL_73_26 rifcsphigho2_02_scaffold_183162, whole genome shotgun sequence
cgccgtcaaggcgatggggttcgcctgaaccgcccgacgcgtcgggctgatgacccctaccgggag

SEQ ID NO: 487 - DNA, 62 bp, Planctomycetes bacterium
  misc_feature (1)..(62): MHZC01000276.1/449-510 Planctomycetes bacterium RIFOXYB12_FULL_42_10 rifoxyb3_full_scaffold_20047_curated, whole genome shotgun sequence
ttacgtccatgcgatggagttcgcttaaccgctataacatagctgataactcctattgaagc

SEQ ID NO: 488 - DNA, 63 bp, Acidiphilium cryptum JF-5
  misc_feature (1)..(63): CP000697.1/677221-677283 Acidiphilium cryptum JF-5, complete genome
tccgatgccggtgatggagttcaccgtgtaaccgcccgtggggccgatgactcctgttcatat

SEQ ID NO: 489 - DNA, 67 bp, Indibacter alkaliphilus LW1
  misc_feature (1)..(67): ALWO02000052.1/297773-297707 Indibacter alkaliphilus LW1 Indibacter_contig_22, whole genome shotgun sequence
caaacttaaggtgatggggttccgcctaaaaccgcttttcttgaaagctgatgactcctacttcaac

SEQ ID NO: 490 - DNA, 71 bp, Nitrospira moscoviensis strain NSP M-1
  misc_feature (1)..(71): CP011801.1/4168483-4168553 Nitrospira moscoviensis strain NSP M-1, complete genome
taaatccacggtgatggggttcaccggaaccgccttggagagggtctgaggctgataactcctaccttgcc

SEQ ID NO: 491 - DNA, 67 bp, Acinetobacter sp. 38-8
  misc_feature (1)..(67): MKSP01000341.1/21678-21612 Acinetobacter sp. 38-8 SCNpilot_cont_750_p_scaffold_900, whole genome shotgun sequence
tagagcaaaggagatggcattcctcctattgcaaaccgccgttttggctaatgatgcctacgttacc

SEQ ID NO: 492 - DNA, 70 bp, Nitrospirae bacterium
  misc_feature (1)..(70): MNVK01000036.1/188-257 Nitrospirae bacterium CG1_02_44_142 cg1_0.2_scaffold_15996_c, whole genome shotgun sequence
aatttaaaaggcgatggagttcgccgctaaccgctccgataatatcggggccgataactcctgccacccc

SEQ ID NO: 493 - DNA, 70 bp, Peptoniphilus sp. BV3C26
  misc_feature (1)..(70): AWXB01000058.1/76022-75953 Peptoniphilus sp. BV3C26 contig00003, whole genome shotgun sequence
atattttttgggaatgaagttctcccaagatttttctgaactgctataagctgatgacttctgtatttta

SEQ ID NO: 494 - DNA, 73 bp, Candidatus Koribacter versatilis Ellin345
  misc_feature (1)..(73): CP000360.1/3066978-3066906 Candidatus Koribacter versatilis Ellin345, complete genome
caacttcatggcgatggagttcgccctaaccgccgcagccacgttgctgcgtgctgataactcctgccgacac

SEQ ID NO: 495 - DNA, 125 bp, Lactobacillus harbinensis DSM 16991
  misc_feature (1)..(125): AZFW01000008.1/44645-44521 Lactobacillus harbinensis DSM 16991 NODE_11, whole genome shotgun sequence
tatcgaatcggtgatgacgttcgccgagcagccttcggtaaaagcagttgatgtcgcccttttaaaggggcatgaaatgagggctgcaactattacggaatgtaattaatgacgtctacacgcgc

SEQ ID NO: 496 - DNA, 79 bp, Cupriavidus sp. USMAA2-4
  misc_feature (1)..(79): CP017749.1/2328568-2328646 Cupriavidus sp. USMAA2-4 chromosome 2, complete sequence
gttgacacaggagatggtgttcctcctcttttgaagaaaccgcagccgaagatgcgctgctgatgacgcctacagaacc

SEQ ID NO: 497 - DNA, 75 bp, Fusobacterium varium ATCC 27725
  misc_feature (1)..(75): GL988000.1/79407-79481 Fusobacterium varium ATCC 27725 genomic scaffold supercont2.6, whole genome shotgun sequence
taatactttgggaatgaggttctccctttgtgacaacacaaaaaccgcttataagctgatgacttctgcatattt

SEQ ID NO: 498 - DNA, 72 bp, Thiomonas delicata strain DSM 16361
  misc_feature (1)..(72): LT592170.1/1353496-1353425 Thiomonas delicata strain DSM 16361 genome assembly, scaffold: BBA-D_THIARS_scaffold4
aaacgagacggcgatggagttcgccgcaaccgccatcggcgccagccgggggctgatgactcctacccagtg

SEQ ID NO: 499 - DNA, 67 bp, Candidimonas nitroreducens strain SC-089
  misc_feature (1)..(67): NJIH01000001.1/194242-194308 Candidimonas nitroreducens strain SC-089 Scaffold1_1, whole genome shotgun sequence
tgcgcacaaggagatggcattcctccttcaaccgctgatcccatcggctgatgatgcctacgaagct

SEQ ID NO: 500 - DNA, 60 bp, [Clostridium] termitidis CT1112
  misc_feature (1)..(60): AORV01000025.1/80742-80801 [Clostridium] termitidis CT1112 Ct_contig00028, whole genome shotgun sequence
ataaattcaggtgatggagttcacctttaaatgcattgagctaatgactcctactttaat

SEQ ID NO: 501 - DNA, 60 bp, Tissierella creatinophila DSM 6911
  misc_feature (1)..(60): LTDM01000011.1/42823-42764 Tissierella creatinophila DSM 6911 TICR_contig000011, whole genome shotgun sequence
agaatagatggtgatggagttcacctttaaccgcataaagctaatgactcctacaaaaat

SEQ ID NO: 502 - DNA, 71 bp, Burkholderia fungorum strain ATCC BAA-463
  misc_feature (1)..(71): CP010024.1/101616-101546 Burkholderia fungorum strain ATCC BAA-463 plasmid pBIL, complete sequence
gctcaatctggagatggcgttcctcctttaaccatcgcgcttaccgcgcggttaatgacgcctacagttac

SEQ ID NO: 503 - DNA, 67 bp, Pediococcus acidilactici DSM 20284
  misc_feature (1)..(67): GL397067.1/1167953-1167887 Pediococcus acidilactici DSM 20284 genomic scaffold SCAFFOLD1, whole genome shotgun sequence
aactaaataggcgatgacgttcgccgtaaaaataattaaacattaatttgatgacgtctattatttc

SEQ ID NO: 504 - DNA, 65 bp, Eubacterium sp. CAG:274
  misc_feature (1)..(65): FR888464.1/3-67 Eubacterium sp. CAG:274 genomic scaffold, scf34
gggaatgatgttctccctaggactttgtcctgaactgccgaagggctgatggcgtctgcgttttt

SEQ ID NO: 505 - DNA, 71 bp, Firmicutes bacterium
  misc_feature (1)..(71): MGWF01000024.1/12941-13011 Firmicutes bacterium GWF2_51_9 gwf2_scaffold_2190, whole genome shotgun sequence
aataccgacgggaatgaagtactcccctagctctgctaaaaccgccgaaggctgatgacttctacgatctt

SEQ ID NO: 506 - DNA, 71 bp, Burkholderia sp. TJI49
  misc_feature (1)..(71): AEXE01000084.1/25781-25851 Burkholderia sp. TJI49 contig072, whole genome shotgun sequence
gtcgttacgggagatggcatacctccacgaaccgccgcccgaccggtgcggctgatgatgcctacggttcc

SEQ ID NO: 507 - DNA, 63 bp, Pedobacter sp. AJM
  misc_feature (1)..(63): NHOT01000001.1/540633-540695 Pedobacter sp. AJM contig01, whole genome shotgun sequence
tgagcttaaggcgatggggtaccgccaaaaccgcccagacaggctgatgactcctacgattta

SEQ ID NO: 508 - DNA, 68 bp, Chryseobacterium taiwanense strain TPW19
  misc_feature (1)..(68): JWTA01000004.1/441586-441653 Chryseobacterium taiwanense strain TPW19 Contig_4, whole genome shotgun sequence
aatacaaaaggaaatggtgttcttccttacccaaccgctttacaaaagctgatgacgcctgattaata

SEQ ID NO: 509 - DNA, 59 bp, Lactobacillus kefiranofaciens subsp. kefirgranum DSM 10550
  misc_feature (1)..(59): AZEM01000127.1/200252-200310 Lactobacillus kefiranofaciens subsp. kefirgranum DSM 10550 = JCM 8572 strain DSM 10550 NODE_383, whole genome shotgun sequence
atgtaaataggtgatgacgttcaccattaaccgagaaatctaatgatgtctactttatc

SEQ ID NO: 510 - DNA, 77 bp, Verrucomicrobia bacterium
  misc_feature (1)..(77): MNDI01000050.1/530-606 Verrucomicrobia bacterium 13_2_20CM_2_54_15 13_2_20cm_2_scaffold_1464, whole genome shotgun sequence
tccgctcaaggcaatggagtttgccgtcccacctgaaggctgggaaaaccgcgcgagctaatgactccttccaaacg

SEQ ID NO: 511 - DNA, 65 bp, Nitrospira sp. SCGC AG-212-E16
  misc_feature (1)..(65): LSTC01000089.1/8506-8442 Nitrospira sp. SCGC AG-212-E16 AG-212-E16.32, whole genome shotgun sequence
ccgcctacaggggatggagtcccccgtataaccgcctcggccaggctgatgactcctacgctaca

SEQ ID NO: 512 - DNA, 79 bp, Caldicellulosiruptor saccharolyticus DSM 8903
  misc_feature (1)..(79): CP000679.1/782565-782643 Caldicellulosiruptor saccharolyticus DSM 8903, complete genome
gaatatagaggcgatggagttcgccttaaattgccacaagaatgaaaaataccttgtggctgataactcctgtccgtat

SEQ ID NO: 513 - DNA, 67 bp, Lactobacillus farraginis DSM 18382
  misc_feature (1)..(67): BAKI01000030.1/17748-17682 Lactobacillus farraginis DSM 18382 = JCM 14108 DNA, contig: JCM14108.contig00030
aattgatatggcgatgacgttcgcctaaactttatgtccacaaagagttgatgacgtctacctttaa

SEQ ID NO: 514 - DNA, 68 bp, Leptospirillum sp. Group IV &apos
  misc_feature (1)..(68): KI543089.1/1492-1425 Leptospirillum sp. Group IV &apos;UBA BS&apos; genomic scaffold D084_Lepto4S00232, whole genome shotgun sequence
attcctggcggcgatggggttcgcctttccctgttcctgacggacagggtgatgactcctaccatggg

SEQ ID NO: 515 - DNA, 66 bp, Rubrivivax sp. SCN 70-15
  misc_feature (1)..(66): MEGM01000093.1/4345-4410 Rubrivivax sp. SCN 70-15 ABT20_C0093, whole genome shotgun sequence
cgcggccctggagatggcatgcctccatgaaccgccgcgtcagcggctgatgatgcctgcgctggg

SEQ ID NO: 516 - DNA, 62 bp, Paenibacillus sp. oral taxon 786 str. D14
  misc_feature (1)..(62): GG695970.1/494453-494392 Paenibacillus sp. oral taxon 786 str. D14 genomic scaffold supercont1.1, whole genome shotgun sequence
acgcaataaggcgatggagttcgcctaaaccgctcgtttgagctgatgactcctaccagact

SEQ ID NO: 517 - DNA, 72 bp, Eremococcus coleocola ACS-139-V-Col8
  misc_feature (1)..(72): AENN01000001.1/23664-23593 Eremococcus coleocola ACS-139-V-Col8 contig00015, whole genome shotgun sequence
atagaaaaagggaatgaagttctccctggcattagccaaaccgcttgttaagctgatgacttctgcaactta

SEQ ID NO: 518 - DNA, 80 bp, Clostridiales bacterium KA00274
  misc_feature (1)..(80): KQ959596.1/130248-130327 Clostridiales bacterium KA00274 genomic scaffold Scaffold100, whole genome shotgun sequence
acaaataaagggaatgaagttctccctaagtaatatatttacttaaaacgcctattaaagctgatgacttctgcgattaa

SEQ ID NO: 519 - DNA, 61 bp, Burkholderia sp. STM 7183
  misc_feature (1)..(61): CYGY02000009.1/35870-35810 Burkholderia sp. STM 7183 genome assembly, contig: CYGY01000009
gcgcgcgccggagatggcattctcctgaaccgccctcgtggctgatgatgcctgcttcgcc

SEQ ID NO: 520 - DNA, 80 bp, Rhizobium sp. MH17 C775; identical to SEQ ID NO: 431
  misc_feature (1)..(80): MKIO01000015.1/6805-6884 Rhizobium sp. MH17 C775, whole genome shotgun sequence

SEQ ID NO: 521 - DNA, 65 bp, Pedobacter cryoconitis strain PAMC 27485
  misc_feature (1)..(65): CP014504.1/3076196-3076132 Pedobacter cryoconitis strain PAMC 27485, complete genome
tgctgacacggaaatggtgtcttccgacttaaccgccctgaaaagctgatggcgcctgcaaaatt

SEQ ID NO: 522 - DNA, 77 bp, Sphingobium sp. Ant17
  misc_feature (1)..(77): JEMV01000013.1/77002-76926 Sphingobium sp. Ant17 Contig_2057, whole genome shotgun sequence
atcgacctcggcaatggatttctgccgggcaatttggccgaaccgctctgacatgagctgatgattcctacttggcg

SEQ ID NO: 523 - DNA, 62 bp, Alicyclobacillus hesperidum
  misc_feature (1)..(62): AKZN01000023.1/24873-24934 Alicyclobacillus hesperidum URH17-3-68 URH17368ctg23, whole genome shotgun sequence
taatcaagtggtgatggggctcaccaaaaccgcccgcgagggatgatggctcctgcaacgta

SEQ ID NO: 524 - DNA, 97 bp, Planktothricoides sp. SR001
  misc_feature (1)..(97): LIUQ01000028.1/83647-83743 Planktothricoides sp. SR001 contig_114, whole genome shotgun sequence
aataatgatggcgatggggctcgccaaaaccgccgtaagtttgccaagaatttgccaagaatttgaccagaccaaggctgatggctcctactattcc

SEQ ID NO: 525 - DNA, 74 bp, Solobacterium moorei F0204
  misc_feature (1)..(74): GL637644.1/113943-114016 Solobacterium moorei F0204 genomic scaffold Scfld15, whole genome shotgun sequence
atttctgacggaaatggggttttccaagattataaatctaaactgctataagtgctgataactcctgtaacttc

SEQ ID NO: 526 - DNA, 75 bp, Mycobacterium xenopi 3993
  misc_feature (1)..(75): JAOC01000010.1/320154-320228 Mycobacterium xenopi 3993 GMX3993.contig.9, whole genome shotgun sequence
acttgcaccggcgatggagcccgtccggaagtgcgacttccgaaccgccacaaggctgatggcttctacgaacga

SEQ ID NO: 527 - DNA, 104 bp, Mumia flava strain MUSC 201
  misc_feature (1)..(104): JTDJ01000052.1/49642-49539 Mumia flava strain MUSC 201 Contig52, whole genome shotgun sequence
gcggccagcggagatggcatgcctccctgcggtcgtagtcggcgcgttgcgcacggtgcggccctcaaccgccggtcagcccggctgatgatgcctgcgtgttc

SEQ ID NO: 528 - DNA, 79 bp, Gluconacetobacter diazotrophicus PAl 5
  misc_feature (1)..(79): AM889285.1/3849897-3849819 Gluconacetobacter diazotrophicus PAl 5 complete genome
gtcggcgcaggcaatggatttctgcctgaccgtccgggtcgaaccgcctctttcgggggctgatgattcctacccaccg

SEQ ID NO: 529 - DNA, 77 bp, Rhizobium sp. Root708
  misc_feature (1)..(77): LMHV01000041.1/1557-1633 Rhizobium sp. Root708 contig_6, whole genome shotgun sequence
accgggcacggtaatggattctgccgggccgtggtggccgaaccgcttgcttgcaagctgatgactcctactcgtga

SEQ ID NO: 530 - DNA, 70 bp, Gemella asaccharolytica strain KA00071
  misc_feature (1)..(70): KQ959855.1/1372-1303 Gemella asaccharolytica strain KA00071 genomic scaffold Scaffold1, whole genome shotgun sequence
agtactattgggaatgaagttctcccaagaaaaataaatgcttattttagctgatgacttctacaaattt

SEQ ID NO: 531 - DNA, 68 bp, Geosporobacter ferrireducens strain IRF9
  misc_feature (1)..(68): CP017269.1/4333368-4333435 Geosporobacter ferrireducens strain IRF9, complete genome
agaaaaatcggtgatggagctcacctttaagcattgcaggatatgcaattaatggctcctacttggcc

SEQ ID NO: 532 - DNA, 62 bp, Candidatus Brocadia sinica JPN1
  misc_feature (1)..(62): BAFN01000001.1/1082359-1082420 Candidatus Brocadia sinica JPN1 DNA, contig: brosiA
aatatttagagcgatggagttcgcttaactgctacattgtagctgataactcctgttgaagt

SEQ ID NO: 533 - DNA, 69 bp, Bacteroides sp. CAG:714
  misc_feature (1)..(69): FR893892.1/35353-35285 Bacteroides sp. CAG:714 genomic scaffold, scf102
ctgctaaaagggaatgggacttccctgtcataaaccgctaagaaaatagctgatagttcctgtcgtgag

SEQ ID NO: 534 - DNA, 65 bp, Clostridium sp. Maddingley MBC34-26
  misc_feature (1)..(65): ALXI01000102.1/10533-10597 Clostridium sp. Maddingley MBC34-26 contig_203_1, whole genome shotgun sequence
aatttcataggtgatgaagttcgcctttaaacatctctttggagattaatgacttctactataat

SEQ ID NO: 535 - DNA, 66 bp, Granulicella mallensis MP5ACTX8
  misc_feature (1)..(66): CP003130.1/3651628-3651693 Granulicella mallensis MP5ACTX8, complete genome
agcattcatggcgatggggttcgcctgccgctccgcacgcgcgtagctgatgactcctacatctcg

SEQ ID NO: 536 - DNA, 62 bp, Heliobacterium modesticaldum Ice1
  misc_feature (1)..(62): CP000930.2/1203106-1203045 Heliobacterium modesticaldum Ice1, complete genome
aagggaatacgcgatggagttcgcggtaaagccgttttgcggatgatgactcctactcgatt

SEQ ID NO: 537 - DNA, 63 bp, Planctomycetes bacterium
  misc_feature (1)..(63): MHYC01000102.1/4812-4874 Planctomycetes bacterium RBG_13_44_8b RBG_13_scaffold_73617, whole genome shotgun sequence
aatttctgcggagatggagttctccgtataaccgcccaaaaggctgataactcctgcagtatt

SEQ ID NO: 538 - DNA, 68 bp, Hippea maritima DSM 10411
  misc_feature (1)..(68): CP002606.1/1302749-1302816 Hippea maritima DSM 10411, complete genome
cagcttaaaggcggtggagttcgccttaaactgccctctctctttgggccaataactcctgcaaaaac

SEQ ID NO: 539 - DNA, 62 bp, Desulfovibrio piger ATCC 29098
  misc_feature (1)..(62): DS996361.1/121355-121416 Desulfovibrio piger ATCC 29098 Scfld10 genomic scaffold, whole genome shotgun sequence
gaaggtcaaggggatggagtcccccatgaaccgcatgttttgctgatgactcctgccggacc

SEQ ID NO: 540 - DNA, 63 bp, Aedes aegypti strain Liverpool supercont1.1010
  misc_feature (1)..(63): CH478194.1/77118-77180 Aedes aegypti strain Liverpool supercont1.1010 genomic scaffold, whole genome shotgun sequence
ccgacagacggagatgacattcctccataaccgccctcaccggctgatgatgtctacgtaacc

SEQ ID NO: 541 - DNA, 66 bp, Luteibacter rhizovicinus DSM 16549
  misc_feature (1)..(66): JPLB01000025.1/17289-17224 Luteibacter rhizovicinus DSM 16549 Contig_25, whole genome shotgun sequence
ccgtccacaggagatgacataactcctgacccaaccgccgccgtggctgatgatgcctaccatatg

SEQ ID NO: 542 - DNA, 89 bp, Saccharibacter sp. AM169, AM168
  misc_feature (1)..(89): CBLY010000006.1/104416-104504 Saccharibacter sp. AM169, AM168, WGS project CBLY01000000 data, contig: NODE_2
agagggaacggtgatggattgccaccgggttccttgtgggccgaaccgccacccggttgccggggaaggctgatgattcctgccaacag

SEQ ID NO: 543 - DNA, 60 bp, Anoxybacillus sp. B7M1
  misc_feature (1)..(60): CP015436.1/780010-779951 Anoxybacillus sp. B7M1, complete genome.
aattgaagaggcgatggagttcgccgtaattgcctttgagctgatgactcctaccggtat

SEQ ID NO: 544 - DNA, 62 bp, Acetobacteraceae bacterium SCN 69-10 ABS99_C0172
  misc_feature (1)..(62): MEFR01000172.1/7376-7315 Acetobacteraceae bacterium SCN 69-10 ABS99_C0172, whole genome shotgun sequence
gattgacgaggggatggagtcccccttgaaccgccgcagaggctgatgactcctgtcgcgca

SEQ ID NO: 545 - DNA, 64 bp, Solirubrobacterales bacterium 70-9
  misc_feature (1)..(64): MKSH01000238.1/6187-6124 Solirubrobacterales bacterium 70-9 SCNpilot_bf_inoc_scaffold_5980, whole genome shotgun sequence
cgaaactgaggcgatgaggctcgccctcgaccgcggcgccgccgctgatggcctctacggaacg

SEQ ID NO: 546 - DNA, 66 bp, Acetobacter orleanensis JCM 7639
  misc_feature (1)..(66): BAMY01000027.1/11025-11090 Acetobacter orleanensis JCM 7639 DNA, contig: Abol_030
aagccgcaaggggatggggttcaccctttaaccgccccagtaagggctgatgactcctgccgtatc

SEQ ID NO: 547 - DNA, 82 bp, Gordonia effusa NBRC 100432
  misc_feature (1)..(82): BAEH01000015.1/34807-34726 Gordonia effusa NBRC 100432 DNA, contig: GOEFS015
gctgttttcggcgatggatctcgcctggtccgattcttcggcccgaaccgccggctctccggctgatagttcctcctcgtat

SEQ ID NO: 548 - DNA, 62 bp, Thermovenabulum gondwanense strain R270
  misc_feature (1)..(62): LOHZ01000015.1/55129-55190 Thermovenabulum gondwanense strain R270 ATZ99_contig000016, whole genome shotgun sequence
aaaatccaaggtgatggagctcaccgaaaaccgccttttaggctaatagctcctacgtatcg

SEQ ID NO: 549 - DNA, 66 bp, Stenotrophomonas daejeonensis strain JCM 16244
  misc_feature (1)..(66): LDJP01000006.1/10388-10323 Stenotrophomonas daejeonensis strain JCM 16244 contig_6, whole genome shotgun sequence
ccgggcaacggagatggcattcctccgcgaaccgccgcgacagcggctgatgatgcctacgcttgg

SEQ ID NO: 550 - DNA, 64 bp, Caldicellulosiruptor owensensis OL
  misc_feature (1)..(64): CP002216.1/521273-521336 Caldicellulosiruptor owensensis OL, complete genome
attgtaaaaggcgatggagtccgccgtacaaatgccaatgatggctgatgactcctacagatgc

SEQ ID NO: 551 - DNA, 73 bp, Clostridiales bacterium 43-6
  misc_feature (1)..(73): MKRK01000154.1/4187-4115 Clostridiales bacterium 43-6 SCNpilot_BF_INOC_scaffold_3713, whole genome shotgun sequence
aatacctgcgggaatgaagtactcccttgggtaacctaaaccgcttattgaagctgatgacttctgtgatttt

SEQ ID NO: 552 - DNA, 63 bp, Pedobacter kyungheensis strain KACC 16221
  misc_feature (1)..(63): JSYN01000016.1/81103-81041 Pedobacter kyungheensis strain KACC 16221 contig016, whole genome shotgun sequence
tgaaatcagggcgatggggtgccgccaaaaccgccaaaacaggctgatgactcctacgatttt

SEQ ID NO: 553 - DNA, 67 bp, Candidimonas bauzanensis strain CGMCC 1.10190
  misc_feature (1)..(67): FQXE01000023.1/6418-6352 Candidimonas bauzanensis strain CGMCC 1.10190 genome assembly, contig: Ga0070552_123
tgcaccgacggagatggcattcctccgctaaccgtcgctatcagcgactgatgatgcctacaccttc

SEQ ID NO: 554 - DNA, 67 bp, Candidatus Microthrix parvicella RN1
  misc_feature (1)..(67): HG422565.1/3993555-3993621 Candidatus Microthrix parvicella RN1 genomic scaffold, 2605
gccgttggtggcgatggggctcgccctcaactgccggacacctccggctgacggtccctgcgaacga

SEQ ID NO: 555 - DNA, 62 bp, Pseudolabrys sp. Root1462
  misc_feature (1)..(62): LMFS01000001.1/3352987-3353048 Pseudolabrys sp. Root1462 contig_1, whole genome shotgun sequence
ccgcacgatggggatggggtcccccgataaccgccggaatggctgatgactcctgccggatg

SEQ ID NO: 556 - DNA, 78 bp, Tatumella ptyseos ATCC 33301
  misc_feature (1)..(78): JMPR01000012.1/20844-20921 Tatumella ptyseos ATCC 33301 GTPT.assembly.012, whole genome shotgun sequence
ttgttacggggtgatggtgttccacctcaaccaaccgccagtccgtttcatggaatggctgatgacgcctgacataat

SEQ ID NO: 557 - DNA, 82 bp, Jatrophihabitans endophyticus strain DSM 45627
  misc_feature (1)..(82): FQVU01000002.1/320536-320617 Jatrophihabitans endophyticus strain DSM 45627 genome assembly, contig: Ga0131187_102
gtcgggcgaggcgatggatcccgccggggtcgtccgatcggacgacccgaaccgccggccggctgatggttccttctcacga

SEQ ID NO: 558 - DNA, 63 bp, Methylosinus sp. R-45379
  misc_feature (1)..(63): LUUM01000312.1/8605-8667 Methylosinus sp. R-45379 contig_92, whole genome shotgun sequence
ggcgcgccaggggatggggtgccccctacaaccgccgaagaggctgatgactcctgctcaatg

SEQ ID NO: 559 - DNA, 65 bp, Deltaproteobacteria bacterium RBG_16_54_11
  misc_feature (1)..(65): MGQS01000129.1/9858-9922 Deltaproteobacteria bacterium RBG_16_54_11 RBG_16_scaffold_77520, whole genome shotgun sequence
atactaagaggggatggagttcccctgacaattgcccaggccgggctgatgactcctaccgcgca

SEQ ID NO: 560 - DNA, 59 bp, Eubacterium limosum KIST612
  misc_feature (1)..(59): CP002273.2/3698397-3698455 Eubacterium limosum KIST612, complete genome
tggtctcagggcgatggagttcgcctaaaccgcataatgctgatgactcctgtttctta

SEQ ID NO: 561 - DNA, 61 bp, Bacterium SCN 62-11 ABS71_C0471
  misc_feature (1)..(61): MEEQ01000471.1/3206-3146 Bacterium SCN 62-11 ABS71_C0471, whole genome shotgun sequence
agctccaatggggatggagtccccccaaaccgcctccccggctgatgactcctaccacctt

SEQ ID NO: 562 - DNA, 70 bp, Clostridiales bacterium KA00134
  misc_feature (1)..(70): KQ965575.1/5893-5824 Clostridiales bacterium KA00134 genomic scaffold Scaffold22, whole genome shotgun sequence
atgtttagaggaaatgaggtacttccttgggaaacctaaatgcaaatatgctgatgacttctacttttgt

SEQ ID NO: 563 - DNA, 38 bp, Syntrophobacterales bacterium GWC2_56_13
  misc_feature (1)..(38): MICJ01000091.1/164-127 Syntrophobacterales bacterium GWC2_56_13 gwc2_scaffold_5779, whole genome shotgun sequence
ggggttcaccgcaaccgccgctcggctgataactccta

SEQ ID NO: 564 - DNA, 75 bp, Sphingomonas panacis strain DCY99
  misc_feature (1)..(75): CP014168.1/2698639-2698565 Sphingomonas panacis strain DCY99, complete genome
gtgcgccacggtgatggatttccgccgggcattcgccgaaccgctctcacaagagctgatgattcctactgggcg

SEQ ID NO: 565 - DNA, 67 bp, Nitritalea halalkaliphila LW7
  misc_feature (1)..(67): AJYA01000016.1/88384-88450 Nitritalea halalkaliphila LW7 Contig16, whole genome shotgun sequence
tttgtttcaggtgatggggttccacctaaaaaaaaccgccgtatcggctgatgactcctacacagta

SEQ ID NO: 566 - DNA, 77 bp, Clostridium difficile 630
  misc_feature (1)..(77): AM180355.1/782179-782255 Clostridium difficile 630 complete genome
aataattatgggaatgaggttctcccttggatgataatatcctaaactgccaatgagctgatgacttctatgatatc

SEQ ID NO: 567 - DNA, 59 bp, Clostridium cellulovorans 743B
  misc_feature (1)..(59): CP002160.1/406583-406525 Clostridium cellulovorans 743B, complete genome
aaatttataggtgatggagttcaccttaatcgcttgatgctaatgactcctacaggtaa

SEQ ID NO: 568 - DNA, 74 bp, Mycobacterium sherrisii strain BC1_M4
  misc_feature (1)..(74): MIHC01000025.1/13855-13928 Mycobacterium sherrisii strain BC1_M4 PROKKA_contig000025, whole genome shotgun sequence
tgatcgtgaggcgatggatctccgccggggtattgcacccgaaccgccaaccggctgatggctccttcgacgtc

SEQ ID NO: 569 - DNA, 65 bp, Rhodospirillales bacterium
  misc_feature (1)..(65): MHZZ01000169.1/3491-3555 Rhodospirillales bacterium RIFCSPLOWO2_01_FULL_65_14 rifcsplowo2_01_scaffold_42705, whole genome shotgun sequence
tcggcacacggggatggagtcccccgcttgtaaccgccgaagaggctgatgactcctgctgcgcg

SEQ ID NO: 570 - DNA, 76 bp, Clostridiales bacterium
  misc_feature (1)..(76): DS990260.1/2249356-2249281 Clostridiales bacterium 1_7_47_FAA supercont2.1 genomic scaffold, whole genome shotgun sequence
tgtttacaggggaatgaggttctcccttagtgtcatactaaaaccgcttatttaagctgatgacttctgtgtgatt

SEQ ID NO: 571 - DNA, 62 bp, Saccharibacillus sacchari DSM 19268
  misc_feature (1)..(62): KK073875.1/1423111-1423050 Saccharibacillus sacchari DSM 19268 genomic scaffold SacsacDRAFT_Scaffold1.1, whole genome shotgun sequence
gttcaatacggcgatggagttcgccataaccgcctttcggggctaatgactcctacccatga

SEQ ID NO: 572 - DNA, 61 bp, Fervidicola ferrireducens strain Y170
  misc_feature (1)..(61): LOED01000018.1/32047-31987 Fervidicola ferrireducens strain Y170 AN618_contig000018, whole genome shotgun sequence
aagtgaaaaggtgatggagctcaccgaaactgcctttcaggctaatagctcctacaatatc

SEQ ID NO: 573 - DNA, 64 bp, Alkaliphilus metalliredigens QYMF
  misc_feature (1)..(64): CP000724.1/4518368-4518305 Alkaliphilus metalliredigens QYMF, complete genome
atgctcataggcgatggagttcgccattaaccactggataacagttaatgactcctgcgaaaca

SEQ ID NO: 574 - DNA, 80 bp, Rhizobium sp. Root564
  misc_feature (1)..(80): LMGN01000024.1/146807-146886 Rhizobium sp. Root564 contig_9, whole genome shotgun sequence
caagtttttggtaatggattctgccgggccatggtggccgaaccgcttcacgggatgaagctgatgactcctactcaatt

SEQ ID NO: 575 - DNA, 60 bp, Bacillus sporothermodurans strain B4102 NODE_20
  misc_feature (1)..(60): LQYN01000018.1/1414-1355 Bacillus sporothermodurans strain B4102 NODE_20, whole genome shotgun sequence
aatgtaaagggcgatggagttcgccagatgtgctactaggctaatgactcctaccggaaa

SEQ ID NO: 576 - DNA, 62 bp, Thermosinus carboxydivorans Nor1 ctg23
  misc_feature (1)..(62): AAWL01000036.1/2586-2647 Thermosinus carboxydivorans Nor1 ctg23, whole genome shotgun sequence
taagtttgcggcgatggagttcgccataagtccgcataagcggtaatgactcctaccaggac

SEQ ID NO: 577 - DNA, 63 bp, Acidithiobacillus thiooxidans strain A02
  misc_feature (1)..(63): LWSA01000079.1/6883-6945 Acidithiobacillus thiooxidans strain A02 contig079, whole genome shotgun sequence
aattgacatggtgatgaagtccaccaaataaccgccattgtggctgatgacttctacatgact

SEQ ID NO: 578 - DNA, 86 bp, Ruminococcus sp. YE71
  misc_feature (1)..(86): FPIR01000010.1/55645-55730 Ruminococcus sp. YE71 genome assembly, contig: IE40DRAFT_scaffold00010.10
tctcatatcgggaatgatgttctcccgcatacggctccgagcgagcctgtgaaaccgctttcaaagctgatgacttctgcgttcct

SEQ ID NO: 579 - DNA, 64 bp, Bacteroidales bacterium TBC1
  misc_feature (1)..(64): DF968182.1/1455626-1455563 Bacteroidales bacterium TBC1 DNA, scaffold: TBC1_scaffold_1
tttgccgcaggctatggggttagcctttaaccgccttcaacaagctgataactcctggatgatt

SEQ ID NO: 580 - DNA, 60 bp, Clostridium autoethanogenum DSM 10061
  misc_feature (1)..(60): CP006763.1/431726-431785 Clostridium autoethanogenum DSM 10061, complete genome
tattttataggtgatggagctcacctttaattgcttatggctgatagcccctactttaat

SEQ ID NO: 581 - DNA, 79 bp, Pyrococcus furiosus DSM 3638
  misc_feature (1)..(79): AE009950.1/1333263-1333185 Pyrococcus furiosus DSM 3638, complete genome
gttctttggggtgatggcgccgcccggggcttcgagccgaaccgcctcccgttgggaggctgatggcgcctattctgta

SEQ ID NO: 582 - DNA, 63 bp, Desulfonatronospira thiodismutans ASO3-1 ctg21
  misc_feature (1)..(63): ACJN02000001.1/209444-209506 Desulfonatronospira thiodismutans ASO3-1 ctg21, whole genome shotgun sequence
cgcctgaaaggggatggagttccccctggtaaccgccgtgatgctgatgactcctgttgtttt

SEQ ID NO: 583 - DNA, 67 bp, Candidimonas nitroreducens strain SC-089
  misc_feature (1)..(67): NJIH01000001.1/186315-186381 Candidimonas nitroreducens strain SC-089 Scaffold1_1, whole genome shotgun sequence
ggccgcaaaggagatggcattcctcctgtaaaccgccaccataccggctaatgatgcctacctgttc

SEQ ID NO: 584 - DNA, 76 bp, Tenericutes bacterium
  misc_feature (1)..(76): MIDC01000012.1/36114-36189 Tenericutes bacterium RIFOXYB2_FULL_36_25 rifoxyb2_full_scaffold_21, whole genome shotgun sequence
catagaagagggaatgaacgtctcccttagtcaaccatgactaaaaccgcaacatgctaatgacttctacaacacg

SEQ ID NO: 585 - DNA, 67 bp, Rubrobacter radiotolerans strain RSPS-4
  misc_feature (1)..(67): CP007516.1/143851-143917 Rubrobacter radiotolerans strain RSPS-4 plasmid 2, complete sequence
agagcaacgggtgatgaagctcacctctataaccgcatcgaaagatgctgatggcttctaccagggc

SEQ ID NO: 586 - DNA, 60 bp, [Clostridium] acidurici 9a
  misc_feature (1)..(60): CP003326.1/2952530-2952589 [Clostridium] acidurici 9a chromosome, complete genome
aaaactcacggcgatggagttcgccattaaatgcgtaaagctgatgactcctacaaagta

SEQ ID NO: 587 - DNA, 70 bp, Plautia stali symbiont
  misc_feature (1)..(70): AP012551.1/1598812-1598881 Plautia stali symbiont DNA, complete genome
ggacggcagggtgatggcgttccacctttcccaaccgttccgttccggaactgatgacgcctgatgtgac

SEQ ID NO: 588 - DNA, 63 bp, Gluconobacter oxydans H24
  misc_feature (1)..(63): CP003926.1/1813274-1813336 Gluconobacter oxydans H24, complete genome
tcgtgtaagggagatggagttcctcccgtaaccgccctaagggctgatgactcctgccgaagc

SEQ ID NO: 589 - DNA, 59 bp, Desulfovibrio desulfuricans subsp. desulfuricans str. ATCC 27774
  misc_feature (1)..(59): CP001358.1/1325490-1325548 Desulfovibrio desulfuricans subsp. desulfuricans str. ATCC 27774, complete genome
ttgaacgcaggggatggagttccccttgaaccgcatttgctgatgactcctgccagacc

SEQ ID NO: 590 - DNA, 73 bp, Coprobacillus sp. CAG:235
  misc_feature (1)..(73): HF995081.1/61766-61694 Coprobacillus sp. CAG:235 genomic scaffold, scf229
ttaatccatgggaatgaggttctccctcgatttatatcgaaaccgctatttggctaatgacttctgtgtaata

SEQ ID NO: 591 - DNA, 69 bp, Alkalibacterium sp. 20
  misc_feature (1)..(69): LSRN01000054.1/3034-3102 Alkalibacterium sp. 20 contig48, whole genome shotgun sequence
taacaaataggcgatggtgttcgcctttaactatcataaatagatatgattaatgacgcctacttagac

SEQ ID NO: 592 - DNA, 72 bp, Clostridium sp. SCN 57-10 ABT01_C0106
  misc_feature (1)..(72): MEFT01000106.1/933-1004 Clostridium sp. SCN 57-10 ABT01_C0106, whole genome shotgun sequence
acaaagcaagggaatgaagttctcccgcgggcgctgcccgaaaccgcttttgctgatgacttctgcaatttg

SEQ ID NO: 593 - DNA, 62 bp, Lactobacillus camelliae DSM 22697
  misc_feature (1)..(62): AYZJ01000062.1/6126-6187 Lactobacillus camelliae DSM 22697 = JCM 13995 strain DSM 22697 NODE_98, whole genome shotgun sequence
aagtgaaatggtgatgacgttcaccctaatacaagctaattgttgatgacgtctgtcttaat

SEQ ID NO: 594 - DNA, 64 bp, Streptomyces sp. Tu 6176
  misc_feature (1)..(64): KK106988.1/2432078-2432141 Streptomyces sp. Tu 6176 genomic scaffold scaffold00001, whole genome shotgun sequence
gacggagacggcgatgaggctcgcccttgaccgcacaccccgtgctgatggcctctgtgaacga

SEQ ID NO: 595 - DNA, 77 bp, Ethanoligenens harbinense YUAN-3
  misc_feature (1)..(77): CP002400.1/470084-470160 Ethanoligenens harbinense YUAN-3, complete genome
cgcatatcggggaatgaagtgctccccgggcgtttgccataactgccaatacacaggctgatgacttctgtgatcga

SEQ ID NO: 596 - DNA, 58 bp, Peptococcaceae bacterium BRH_c4b
  misc_feature (1)..(58): LADO01000039.1/63932-63875 Peptococcaceae bacterium BRH_c4b BRHa_1004828, whole genome shotgun sequence
tataattttggcgatggggctcgcctaatgctgcgaagctgatggctcctaccacaag

SEQ ID NO: 597 - DNA, 52 bp, Deltaproteobacteria bacterium
  misc_feature (1)..(52): MNYH01000071.1/4-55 Deltaproteobacteria bacterium CG2_30_66_27 cg2_3.0_scaffold_10978_c, whole genome shotgun sequence
cgatggagttcgccgtgaaccgcccgaacgggctgatgactcctggttgtat

SEQ ID NO: 598 - DNA, 63 bp, Pseudomonas knackmussii B13
  misc_feature (1)..(63): HG322950.1/4730010-4729948 Pseudomonas knackmussii B13 complete genome
cgcgattcaggagatggcattcctcctttaaccgcccctggggctgatgatgcctacgcattc

SEQ ID NO: 599 - DNA, 69 bp, Providencia rettgeri strain MR4; identical to SEQ ID NO: 262
  misc_feature (1)..(69): LCVM01000141.1/4442-4374 Providencia rettgeri strain MR4 P_rettgeri_contig_141, whole genome shotgun sequence

SEQ ID NO: 600 - DNA, 63 bp, Lactobacillus johnsonii NCC 533
  misc_feature (1)..(63): AE017198.1/798633-798695 Lactobacillus johnsonii NCC 533, complete genome
atttaatatggtgatggtgttcaccaatttaaccgattaatatctgacgacgcctactttctt

SEQ ID NO: 601 - DNA, 75 bp, Lactococcus lactis subsp. lactis Il1403
  misc_feature (1)..(75): AE005176.1/1105212-1105286 Lactococcus lactis subsp. lactis Il1403, complete genome
ataaatgatgggtatggtgcacacccgaaaccgctttaagaataaaatcttaaaactaatggcgcctacaaacaa

SEQ ID NO: 602 - DNA, 83 bp, Calothrix sp. PCC 7507
  misc_feature (1)..(83): CP003943.1/2856403-2856485 Calothrix sp. PCC 7507, complete genome
aacgactatggcgatggagctcgccaaaaccgcctcttcagtaaaagatttataactgcaaggctgatggctcctacttttcc

SEQ ID NO: 603 - DNA, 69 bp, Bacteroides coprocola DSM 17136
  misc_feature (1)..(69): DS981450.1/8984-9052 Bacteroides coprocola DSM 17136 Scfld_02_23 genomic scaffold, whole genome shotgun sequence
caaagtcaggggaatgggacttccctgttataaaccgctaataaagtagctgatagttcctgccggagt

SEQ ID NO: 604 - DNA, 61 bp, Listeria aquatica FSL S10-1188 c5
  misc_feature (1)..(61): AOCG01000006.1/242070-242010 Listeria aquatica FSL S10-1188 c5, whole genome shotgun sequence
tactgaaaaggtgatggagttcgcctaaaatgtgatattcgctgatgactcctatttaaat

SEQ ID NO: 605 - DNA, 75 bp, Bacteroides capillosus ATCC 29799
  misc_feature (1)..(75): AAXG02000029.1/31858-31932 Bacteroides capillosus ATCC 29799 B_capillosus-2.0.1_Cont263, whole genome shotgun sequence
gtgaatcaggggaatgaagtgctccccggggcgtggccccgaaccgcgtttgacgctgatgacttctgcattttg

SEQ ID NO: 606 - DNA, 77 bp, Pantoea sp. AS1 5__len__86521
  misc_feature (1)..(77): MWUE01000006.1/31346-31270 Pantoea sp. AS1 5__len__86521, whole genome shotgun sequence
acgccttaaggtgatggcgttccacctttgccaaccgcctgctggcgatcccagcggctgatgacgcctgacattaa

SEQ ID NO: 607 - DNA, 78 bp, Mesotoga prima
  misc_feature (1)..(78): LGGP01000002.1/11694-11617 Mesotoga prima MPI_scaffold_981, whole genome shotgun sequence
aattctctaggcaatgaagcttgccttggagaacagtcttccggaaccgcttttttggctgatagtttctgcgattat

SEQ ID NO: 608 - DNA, 62 bp, Archaeoglobus fulgidus DSM 4304
  misc_feature (1)..(62): AE000782.1/1391410-1391471 Archaeoglobus fulgidus DSM 4304, complete genome
atcggtatgggtgatggcgtccaccttcaaccgccgctaaggctgatgacgcctgttctcag

SEQ ID NO: 609 - DNA, 76 bp, Gordonia polyisoprenivorans VH2
  misc_feature (1)..(76): CP003119.1/3751759-3751684 Gordonia polyisoprenivorans VH2, complete genome
tcggccgcgggtgatggatctcgcccgggccgcgccggcccgaaccgccgacaaggctgatggctcctgttccgat

SEQ ID NO: 610 - DNA, 61 bp, Planctomycetes bacterium; identical to SEQ ID NO: 462
  misc_feature (1)..(61): MHYT01000009.1/1931-1991 Planctomycetes bacterium RIFCSPHIGHO2_12_39_6 rifcsphigho2_12_sub10_scaffold_10301, whole genome shotgun sequence

SEQ ID NO: 611 - DNA, 66 bp, Hippea maritima DSM 10411
  misc_feature (1)..(66): CP002606.1/544616-544551 Hippea maritima DSM 10411, complete genome
tcaaaaaaaggctatgaggttagcctaaaaagccccgccaaaggggatgataacctctactcgata

SEQ ID NO: 612 - DNA, 72 bp, Pantoea sp. At-9b plasmid pPAT9B02
  misc_feature (1)..(72): CP002435.1/144988-144917 Pantoea sp. At-9b plasmid pPAT9B02, complete sequence
tgagtcgaaggtgatggcgttccaccttatccaaaccgctccctcgctggagctgatgacgcctggtatgtc

SEQ ID NO: 613 - DNA, 71 bp, Ruminococcus sp. CAG:330
  misc_feature (1)..(71): CBIH010000205.1/2901-2971 Ruminococcus sp. CAG:330, WGS project CBIH01000000 data, contig: 9
ttcaagatcgggaatgatgttctcccctgggattccaaaaccgctgtttcgctgatgacgtctgctttttt

SEQ ID NO: 614 - DNA, 67 bp, Cecembia lonarensis LW9
  misc_feature (1)..(67): AMGM01000055.1/23054-22988 Cecembia lonarensis LW9 contig000055, whole genome shotgun sequence
caagatctaggtgatggggtaccacctttaaccgcccttttttggtgctgatgactcctgcttcaac

SEQ ID NO: 615 - DNA, 62 bp, Planctomycetes bacterium; identical to SEQ ID NO: 487
  misc_feature (1)..(62): MHXS01000153.1/2999-2938 Planctomycetes bacterium GWB2_41_19 gwb2_scaffold_6965, whole genome shotgun sequence

SEQ ID NO: 616 - DNA, 60 bp, Bacillus sp. VT-16-70
  misc_feature (1)..(60): MPHG01000248.1/37571-37630 Bacillus sp. VT-16-70 Bacillus_obstructivus_contig232, whole genome shotgun sequence
taaatatgcggcgatggagttcgcccttaagtgcttaaagctaatgactcctaccctatt

SEQ ID NO: 617 - DNA, 62 bp, Candidatus Lindowbacteria bacterium
  misc_feature (1)..(62): MFPR01000009.1/26239-26178 Candidatus Lindowbacteria bacterium RIFCSPLOWO2_12_FULL_62_27 rifcsplowo2_12_scaffold_1449, whole genome shotgun sequence
agatgtgcaggcgatggagttcgccttaaccgcccctaccggctgatgactcctaccacatg

SEQ ID NO: 618 - DNA, 63 bp, Sphingomonas sp. 67-36
  misc_feature (1)..(63): MKSU01000016.1/336643-336581 Sphingomonas sp. 67-36 SCNpilot_cont_300_bf_scaffold_251, whole genome shotgun sequence
catggtgacggggatggagttccccgataaccgccgttccgggctgatgactcctaccaacac

SEQ ID NO: 619 - DNA, 65 bp, Bacterium UASB270
  misc_feature (1)..(65): DF820472.1/159652-159588 Bacterium UASB270 DNA, scaffold: UASB270_scaffold_10
gcctttcgaggggatggagttcccctgacaaatgcccggcaagggctgatgactcctgcgatgcg

SEQ ID NO: 620 - DNA, 73 bp, Desulfobacteraceae bacterium 4484_190.3
  misc_feature (1)..(73): MVDC01000122.1/5278-5350 Desulfobacteraceae bacterium 4484_190.3 ex4484_190.3_scaffold_20784, whole genome shotgun sequence
tagcaataaggggatggagtcccccgcataattgtccaaccgcttcaaaagggctaatgactcctgtcgcgtg

SEQ ID NO: 621 - DNA, 68 bp, Smithella sp. SDB
  misc_feature (1)..(68): LKUC01000117.1/3567-3500 Smithella sp. SDB scaffold-15358, whole genome shotgun sequence
acatgaataggtgatggagttcacctaagattaaccgcttttatatagctgataactcctgcagaaaa

SEQ ID NO: 622 - DNA, 82 bp, Humibacillus sp. DSM 29435
  misc_feature (1)..(82): MAST01000002.1/541-622 Humibacillus sp. DSM 29435 contig10, whole genome shotgun sequence
gtcggagacggcgatggatcccgcctgggcgtgccggcttcaccccgaactgccagctccggctgatggttcctgactcgtc

SEQ ID NO: 623 - DNA, 88 bp, Agrobacterium radiobacter K84
  misc_feature (1)..(89): CP000628.1/2724502-2724415 Agrobacterium radiobacter K84 chromosome 1, complete sequence
aaatccaacggtaatggatttctgccgggccatggtggccgaaccgctgctctgaagattcagggaagctgatgactcctactcaacg

SEQ ID NO: 624 - DNA, 62 bp, Pseudonocardia sp. SCN 72-86 ABS81_C0007
  misc_feature (1)..(62): MEFA01000007.1/60862-60923 Pseudonocardia sp. SCN 72-86 ABS81_C0007, whole genome shotgun sequence
tcagcacacggcgatggggctcgcctttgaccgcctaaccggctgatagctcctaccaacgg

SEQ ID NO: 625 - DNA, 80 bp, Tessaracoccus bendigoensis DSM 12906
  misc_feature (1)..(80): FQZG01000024.1/3478-3557 Tessaracoccus bendigoensis DSM 12906 genome assembly, contig: EK12DRAFT_scaffold00022.22
gttcgacccggtgatggaccccgccggggccggttgatccggcccgaaccgcctctttggctgatggctcctgtccaccg

SEQ ID NO: 626 - DNA, 72 bp, Blautia sp. CAG:257
  misc_feature (1)..(72): HF998978.1/5102-5031 Blautia sp. CAG:257 genomic scaffold, scf4
aatgaatttgggaatgaagttctcccaagggaaacctgaactgcttattaagctgatgacttctgagattat

SEQ ID NO: 627 - DNA, 64 bp, Shinella sp. 65-6
  misc_feature (1)..(64): MKSC01000083.1/2627-2690 Shinella sp. 65-6 SCNpilot_expt_1000_bf_scaffold_14020, whole genome shotgun sequence
ccgtgggatggggatggagctccccgacaactgccgttcatcggctgatagctcctgccagacc

SEQ ID NO: 628 - DNA, 69 bp, Halobacteriaceae archaeon SB9
  misc_feature (1)..(69): LOPU01000003.1/23382-23314 Halobacteriaceae archaeon SB9 contig_11, whole genome shotgun sequence
tatcactcgggcaatggagtctgccccacccaaccgccgaacacgtcggctgatgactccttctcgtca

SEQ ID NO: 629 - DNA, 65 bp, Bacteroides graminisolvens DSM 19988
  misc_feature (1)..(65): BAJS01000008.1/110947-110883 Bacteroides graminisolvens DSM 19988 = JCM 15093 DNA, contig: JCM15093.contig00008
tccgatttcggcaatggattctgcctttaaccgcccttcgtggggctgatgactcctacttggaa

SEQ ID NO: 630 - DNA, 72 bp, Ruminococcus sp. CAG:57
  misc_feature (1)..(72): FR890736.1/26782-26711 Ruminococcus sp. CAG:57 genomic scaffold, scf82
ctcatatcggggaatgatgttctcccctgggaaacctaaaccgcttattaagctgatgacttctgtttttta

SEQ ID NO: 631 - DNA, 66 bp, Pyrinomonas methylaliphatogenes
  misc_feature (1)..(66): CBXV010000007.1/153141-153206 Pyrinomonas methylaliphatogenes, K22, WGS project CBXV01000000 data, contig: PYK22_K22_C11
aaagttcagggtgatggagtccaccatcaaccactgcgatcggcagttgatgactcctatttcgaa

SEQ ID NO: 632 - DNA, 78 bp, Verrucomicrobia bacterium
  misc_feature (1)..(78): MIDS01000081.1/1568-1491 Verrucomicrobia bacterium RIFCSPLOWO2_12_FULL_64_8 rifcsplowo2_12_scaffold_126916, whole genome shotgun sequence
gtttggcccggcgatggattccgcctccccgcgagggaaaaccgccgcgcttgcgtggctaatgactcctgttgatcc

SEQ ID NO: 633 - DNA, 68 bp, Trichococcus sp. R210 isolate Trichococcus_R210
  misc_feature (1)..(68): FJNB01000023.1/1869-1802 Trichococcus sp. R210 isolate Trichococcus_R210 genome assembly, contig: TR210DRAFT_scaffold-23
tagtatgtcggcgatggtgttcgcctttaactatcataataactatgattaatgacacctacttaaat

SEQ ID NO: 634 - DNA, 76 bp, Mycoplasma anatis 1340
  misc_feature (1)..(76): AFVJ01000019.1/16616-16691 Mycoplasma anatis 1340 contig26, whole genome shotgun sequence
aataataacgggaatgatgttctccctgttggattaaacaaaccgcatttttaatgctaatgacgtctacgacttt

SEQ ID NO: 635 - DNA, 63 bp, Geobacillus thermodenitrificans NG80-2
  misc_feature (1)..(63): CP000557.1/2739339-2739277 Geobacillus thermodenitrificans NG80-2, complete genome
aacatactaggcgatggggttcgccataaccaccggcttcctgctgatgactcctgctgcgtt

SEQ ID NO: 636 - DNA, 79 bp, Metallosphaera sedula DSM 5348
  misc_feature (1)..(79): CP000682.1/1397941-1398019 Metallosphaera sedula DSM 5348, complete genome
taggttactggggatggcgtcccccagggcttgttcccgaaccgcctgatacatgaaggctgatgacgcctatctcttg

SEQ ID NO: 637 - DNA, 74 bp, Clostridium sp. KLE 1755
  misc_feature (1)..(74): KE992666.1/27697-27770 Clostridium sp. KLE 1755 genomic scaffold Scaffold204, whole genome shotgun sequence
ataaggtccgggaatgaagttctcccatggctattgccaaaaccgctgataaagctgatgacttctgtgatttt

SEQ ID NO: 638 - DNA, 80 bp, Synechococcus sp. PCC 7002
  misc_feature (1)..(80): CP000957.1/84698-84619 Synechococcus sp. PCC 7002 plasmid pAQ7, complete sequence
tttagcgatggtgatggagctcaccgaaaccgcccaggatttttcttaattgcacctcggctaatggctcctacgcttcc

SEQ ID NO: 639 - DNA, 70 bp, Erwinia billingiae strain Eb661
  misc_feature (1)..(70): FP236826.1/96294-96225 Erwinia billingiae strain Eb661 complete plasmid pEB102
atatgacaaggtgatggcgttccacctttcccaaccgctccgttccggagctgatgacgcctgatgcgac

SEQ ID NO: 640 - DNA, 67 bp, Acetohalobium arabaticum DSM 5501
  misc_feature (1)..(67): CP002105.1/948502-948436 Acetohalobium arabaticum DSM 5501, complete genome
acatattatggtgatggagctcgccgttaactattgcattcttgcaattgatggctcctatttgggt

SEQ ID NO: 641 - DNA, 63 bp, Planctomycetes bacterium
  misc_feature (1)..(63): MHYP01000280.1/11687-11749 Planctomycetes bacterium RIFCSPHIGHO2_02_FULL_38_41 rifcsphigho2_02_scaffold_83486, whole genome shotgun sequence
tgcgtcaagggcgatggagttcgccataattgctacaaaatagctgataactcctgtagaagt

SEQ ID NO: 642 - DNA, 64 bp, Stenotrophomonas maltophilia SKK35
  misc_feature (1)..(64): CALN01000517.1/3428-3365 Stenotrophomonas maltophilia SKK35, WGS project CALN01000000 data, contig: 517
ggccgcgatggggatggagctcccccgataaccgcctgcaagggctgatggctcctgccaagac

SEQ ID NO: 643 - DNA, 62 bp, Ferrimicrobium acidiphilum DSM 19497 strain T23
  misc_feature (1)..(62): JXUW01000032.1/3544-3605 Ferrimicrobium acidiphilum DSM 19497 strain T23 FEAC_contig000032, whole genome shotgun sequence
agtccaaagggtgatggagtccaccttgcaacgccgaattggctgatgactcctctgataag

SEQ ID NO: 644 - DNA, 67 bp, Belliella baltica DSM 15883
  misc_feature (1)..(67): CP003281.1/1599165-1599231 Belliella baltica DSM 15883, complete genome
tgatgcttaggtgatggggttccaccttcaaccgcccatttttggtgctgatgactcctacttcaac

SEQ ID NO: 645 - DNA, 78 bp, Bradyrhizobium sp. BR 10245
  misc_feature (1)..(78): LUUB01000092.1/109091-109014 Bradyrhizobium sp. BR 10245 contig61, whole genome shotgun sequence
cacacagatggggatggagtcccccgataaccgcccggcggccaacgaccgtagtgggctgatgactcctgctcgagg

SEQ ID NO: 646 - DNA, 66 bp, Desulfatitalea sp. BRH_c12 BRHa_1003278
  misc_feature (1)..(66): LADR01000066.1/7173-7238 Desulfatitalea sp. BRH_c12 BRHa_1003278, whole genome shotgun sequence
aaatagattggggatggagtcccccatataaaccgcccgggctgggctgatgactcctaccggcag

SEQ ID NO: 647 - DNA, 61 bp, Mycobacterium heidelbergense strain DSM 44471
  misc_feature (1)..(61): MVHR01000005.1/158203-158143 Mycobacterium heidelbergense strain DSM 44471 NODE_5_length_243907_cov_56.1658, whole genome shotgun sequence
atcgaggcaggcgatgaagctcgccccaattgccacaccggctgatggcttctaccacgtc

SEQ ID NO: 648 - DNA, 68 bp, Deinococcus gobiensis I-0 plasmid P3
  misc_feature (1)..(68): CP002194.1/206403-206336 Deinococcus gobiensis I-0 plasmid P3, complete sequence
agctctataggcgatggcattcgccctccacaaccgccccgtgtccggctgatgatgcctactcctca

SEQ ID NO: 649 - DNA, 73 bp, Ruminococcus sp. SR1/
  misc_feature (1)..(73): FP929053.1/3518373-3518445 Ruminococcus sp. SR1/5 draft genome
aggcagaaagggaatgaagttctcccccgatctttatcgaaaccgccactgagctgatgacttctgtgcaatg

SEQ ID NO: 650 - DNA, 66 bp, Bordetella sp. SCN 67-23
  misc_feature (1)..(66): MEDQ01000035.1/10801-10866 Bordetella sp. SCN 67-23 ABS43_C0035, whole genome shotgun sequence
tatgttcctggagatggcattcctccatgaaccgccgcgcaagcagctgatgatgcctacagatcc

SEQ ID NO: 651 - DNA, 61 bp, Planctomycetes bacterium
  misc_feature (1)..(61): MHXS01000153.1/6879-6819 Planctomycetes bacterium GWB2_41_19 gwb2_scaffold_6965, whole genome shotgun sequence
acaaatcaaggcgatggagttcgcctaacgctacgttgtagctgataactcctattgaagc

SEQ ID NO: 652 - DNA, 68 bp, Dialister sp. CAG:357
  misc_feature (1)..(68): FR896389.1/3937-3870 Dialister sp. CAG:357 genomic scaffold, scf55
aagaaagacggcgatggagttcgccgggcatatgccgaacgcttcgcgctgatgactcctgtccctta

SEQ ID NO: 653 - DNA, 75 bp, Enterococcus asini ATCC 700915
  misc_feature (1)..(75): KB946293.1/246879-246805 Enterococcus asini ATCC 700915 genomic scaffold acvKe-supercont1.3, whole genome shotgun sequence
tgttaataggggaatgatgtctccctcagtttttactgaaaccgcaatgaacttgctaatgacttctgcctcagt

SEQ ID NO: 654 - DNA, 64 bp, Sporomusa malonica strain DSM 5090
  misc_feature (1)..(64): FWXI01000019.1/99800-99863 Sporomusa malonica strain DSM 5090 genome assembly, contig: Ga0070592_119
gatatttggggcgatggagttcgccattaaccccgtgtcgaacggtgatgactcctaccaggtg

SEQ ID NO: 655 - DNA, 62 bp, Clostridium chauvoei JF4335
  misc_feature (1)..(62): CBML010000006.1/1375951-1375890 Clostridium chauvoei JF4335, WGS project CBML01000000 data, contig: 00001
tattatataggtgatggagttcaccattaaatgcttaagaagctaatgactcctactctttt

SEQ ID NO: 656 - DNA, 63 bp, Gammaproteobacteria bacterium RIFCSPLOWO2_12_47_11
  misc_feature (1)..(63): MGYU01000065.1/3913-3975 Gammaproteobacteria bacterium RIFCSPLOWO2_12_47_11 rifcsplowo2_12_sub10_scaffold_394, whole genome shotgun sequence
tttctgaaaggaaatggcattcttccttgaaccgtcccatggactgatgatgcctgcgagttt

SEQ ID NO: 657 - DNA, 62 bp, Clostridium roseum strain DSM 7320
  misc_feature (1)..(62): LZYV01000054.1/19198-19137 Clostridium roseum strain DSM 7320 CROST_contig000054, whole genome shotgun sequence
aatttcataggtgatgaggttcgccgtaaatatcctaatggattgatgacttctgcatatta

SEQ ID NO: 658 - DNA, 73 bp, Pseudomonas sp. Bc-h sc_007
  misc_feature (1)..(73): MUIN01000007.1/366458-366530 Pseudomonas sp. Bc-h sc_007, whole genome shotgun sequence
atcgggcctggagatggcattcctccacttaccaaccgctgcgcccgtagcagctgatgatgcctacagacac

SEQ ID NO: 659 - DNA, 71 bp, Ruminococcus callidus ATCC 27760
  misc_feature (1)..(71): KI260332.1/2642-2572 Ruminococcus callidus ATCC 27760 genomic scaffold Scaffold1390, whole genome shotgun sequence.
gtttccttagggaatgatgttctcccttgggattccaaaaccgcttgagtgctgatgacgtctgcttttta

SEQ ID NO: 660 - DNA, 84 bp, Vibrio splendidus LGP32
  misc_feature (1)..(84): FM954972.2/699217-699134 Vibrio splendidus LGP32 chromosome 1
tagccatcaggtgatggggttccacctaagcttttgcttcaaccgcccgttcttttgaaccgtgctaatgactcctacagaatc

SEQ ID NO: 661 - DNA, 105 bp, Burkholderia sp. TJI49
  misc_feature (1)..(105): AEXE01001175.1/192-296 Burkholderia sp. TJI49 contig634, whole genome shotgun sequence
gtcggctgcggagatggcatgcctccctgcggtcgccggcggcgcgtggcgcgcggcccggaccctcaaccgccggtgcgtccggctgatgatgcctgcgtgttc

SEQ ID NO: 662 - DNA, 75 bp, Niabella sp. BS26
  misc_feature (1)..(75): CP015772.1/1950443-1950517 Niabella sp. BS26, complete genome
ttataaacaggaaatggtgtcttcctgaaccaaccgttcacgccttttgcgggatctgatggcgcctacaaattt

SEQ ID NO: 663 - DNA, 65 bp, Deltaproteobacteria bacterium
  misc_feature (1)..(65): MGQS01000055.1/380-316 Deltaproteobacteria bacterium RBG_16_54_11 RBG_16_scaffold_261725, whole genome shotgun sequence
atactaagaggggatggagttcccctgacaatcgcccaggccgggctgatgactcctacgacgca

SEQ ID NO: 664 - DNA, 59 bp, Clostridium sp. W14A
  misc_feature (1)..(59): MBSV01000068.1/16362-16420 Clostridium sp. W14A NODE_46, whole genome shotgun sequence
taatagattggtgatgaggctcaccacaatgcatttatgctgatggcttctactttaag

SEQ ID NO: 665 - DNA, 75 bp, Leptotrichia goodfellowii F0264
  misc_feature (1)..(75): ADAD01000052.1/93049-92975 Leptotrichia goodfellowii F0264 contig00067, whole genome shotgun sequence
ttatttcatggaaatgatgtctcccgaggcaagtgcctaaaccgctttatttgagctgatgacttctgcatattt

SEQ ID NO: 666 - DNA, 61 bp, Mycobacterium celatum strain DSM 44243
  misc_feature (1)..(61): LQOM01000035.1/130087-130147 Mycobacterium celatum strain DSM 44243 contig_40, whole genome shotgun sequence
tcggcctcaggcgatgaagctcgccttaaccgccgaaccggctgatggcttctacccgtga

SEQ ID NO: 667 - DNA, 60 bp, Chloroflexi bacterium
  misc_feature (1)..(60): MGMG01000019.1/23548-23607 Chloroflexi bacterium GWB2_54_36 gwb2_scaffold_1426, whole genome shotgun sequence
ccccgctgtggtgatggagtccacccttaaccgcttcgtgctgatgactcctgcatttca

SEQ ID NO: 668 - DNA, 66 bp, Streptomyces sp. MUSC 1 53
  misc_feature (1)..(66): MLYO01000053.1/67998-68063 Streptomyces sp. MUSC 1 53, whole genome shotgun sequence
ctggtatccggcgatggggctcgccgccaaccgcacccctggggtgctgatggcctctacccgctg

SEQ ID NO: 669 - DNA, 77 bp, Tatumella morbirosei strain LMG 23360
  misc_feature (1)..(77): JPKR02000005.1/497787-497711 Tatumella morbirosei strain LMG 23360 Contig5, whole genome shotgun sequence
tgacttcggggtgatggtgttccacctcaaccaaccgccgctctgagacctgagcggctgatgacgcctgacataat

SEQ ID NO: 670 - DNA, 71 bp, Ruminococcus sp. CAG:108
  misc_feature (1)..(71): HF987456.1/100469-100539 Ruminococcus sp. CAG:108 genomic scaffold, scf76
aatatgaatgggaatgaggttctcccacggcttttgccgaaaccgcttttgctgatgacttctgttttttg

SEQ ID NO: 671 - DNA, 61 bp, Kozakia baliensis strain DSM 14400
  misc_feature (1)..(61): CP014675.1/5813-5873 Kozakia baliensis strain DSM 14400 plasmid pKB14400_1, complete sequence
cctggacaaggggatggggttcccctgaaaccgccgcaaggctgatgactcctctgtgccg

SEQ ID NO: 672 - DNA, 103 bp, Novosphingobium nitrogenifigens DSM 19370
  misc_feature (1)..(103): GL876933.1/301939-301837 Novosphingobium nitrogenifigens DSM 19370 genomic scaffold scaffold00010, whole genome shotgun sequence
tgcgatgacggcgatggatttccgccgggcctgctgtgccgcacaggccgaaccgcctttcgacgggctctcttgtcgaaaggctgatgattcctgccttcgc

SEQ ID NO: 673 - DNA, 74 bp, Humibacillus sp. DSM 29435
  misc_feature (1)..(74): MAST01000004.1/33923-33850 Humibacillus sp. DSM 29435 contig12, whole genome shotgun sequence
ctgagagaaggtgatggaccccgcctgggtggtgacagccctaactgcattttgctgatggttcctacgacgtt

SEQ ID NO: 674 - DNA, 64 bp, Candidatus Schekmanbacteria bacterium RBG_16_38_11
  misc_feature (1)..(64): MGDF01000100.1/3502-3565 Candidatus Schekmanbacteria bacterium RBG_16_38_11 RBG_16_scaffold_39291, whole genome shotgun sequence
tttaaaaatggcgatggggttcgcctctaaccatccataaaggattgatgacccctactgaaac

SEQ ID NO: 675 - DNA, 72 bp, Thermodesulfobacterium commune DSM 2178
  misc_feature (1)..(72): CP008796.1/645368-645297 Thermodesulfobacterium commune DSM 2178, complete genome
caaagaattggggatggcgtcccccataaatcgcctctaaagtctttaggggctgatgacgcctacctctca

SEQ ID NO: 676 - DNA, 66 bp, Chryseobacterium molle strain DSM 18016
  misc_feature (1)..(66): FRAM01000002.1/331939-332004 Chryseobacterium molle strain DSM 18016 genome assembly, contig: Ga0131196_102
taaaaaaaagggaatggtgtctcccttacccaaccgccctaaaaagctgatggcgcctgattaaaa

SEQ ID NO: 677 - DNA, 62 bp, Paraburkholderia susongensis strain LMG 29540
  misc_feature (1)..(62): FXAT01000002.1/736027-736088 Paraburkholderia susongensis strain LMG 29540 genome assembly, contig: Ga0139082_102
ttcgccgctggagatggcattctccattaaccgccctcggggctgatgatgcctgctacgcc

SEQ ID NO: 678 - DNA, 62 bp, Bradyrhizobium elkanii strain UASWS1015
  misc_feature (1)..(62): JXOF01000129.1/2647-2586 Bradyrhizobium elkanii strain UASWS1015 Contig129, whole genome shotgun sequence
gtatccctcggggatggagttccccattaagcgccaatccggctgatgactcctgcaacggg

SEQ ID NO: 679 - DNA, 59 bp, Clostridium thermocellum ATCC 27405
  misc_feature (1)..(59): CP000568.1/234427-234485 Clostridium thermocellum ATCC 27405, complete genome
tgaataaaaggtgatggagttcacctgaaatgcgtaatgctgatgactcctacaggaat

SEQ ID NO: 680 - DNA, 64 bp, Gemmatimonadetes bacterium
  misc_feature (1)..(64): MNIS01000023.1/10346-10283 Gemmatimonadetes bacterium 13_1_20CM_4_66_11 13_1_20cm_4_scaffold_534, whole genome shotgun sequence
cttacagcaggcgatggagttcgcctcaaaccgcccttttcgggctgatgactcctacccgaac

SEQ ID NO: 681 - DNA, 76 bp, Serratia marcescens FGI94
  misc_feature (1)..(76): CP003942.1/1168935-1168860 Serratia marcescens FGI94, complete genome
atcgaccacggagatgacattcctcccgccccgatagggataaaccgcctgaccggctgatgatgtctgcgtaacc

SEQ ID NO: 682 - DNA, 64 bp, Streptomyces nodosus strain ATCC 14899
  misc_feature (1)..(64): CP009313.1/723035-722972 Streptomyces nodosus strain ATCC 14899 genome
atggaggtgggcgatgaggctcgccctcgaccgcacatcccgtgctgatggcctctgctgccgg

SEQ ID NO: 683 - DNA, 66 bp, Pedobacter sp. PACM 27299
  misc_feature (1)..(66): CP012996.1/2979607-2979542 Pedobacter sp. PACM 27299, complete genome
cacagaaaaggaaatggtgtcttcctgattgaaccgccctaaaaagctgatggcgcctggttaatt

SEQ ID NO: 684 - DNA, 75 bp, Thaumarchaeota archaeon N4
  misc_feature (1)..(75): CBTY010000009.1/201754-201680 Thaumarchaeota archaeon N4, WGS project CBTY01000000 data, contig: APF_1883_Contig_4
acagaacaaggctatgacattagccgtggcgcaagccagaaccgcatcgcgcatgctgataatgtctacacaaag

SEQ ID NO: 685 - DNA, 60 bp, Desulfovibrio sp. X2 ctg17
  misc_feature (1)..(60): ATHV01000008.1/6866-6807 Desulfovibrio sp. X2 ctg17, whole genome shotgun sequence
ggccgccacggggatggagtcccccgagaaccgcaccatgctgatgactcctgccggacg

SEQ ID NO: 686 - DNA, 58 bp, Ferrimicrobium acidiphilum DSM 19497 strain T23
  misc_feature (1)..(58): JXUW01000001.1/2579-2636 Ferrimicrobium acidiphilum DSM 19497 strain T23 FEAC_contig000001, whole genome shotgun sequence
atggcttgcggcgatggagttcgctgatgcgtctcagactgatgactcctactaaagc

SEQ ID NO: 687 - DNA, 62 bp, Clostridium homopropionicum DSM 5847
  misc_feature (1)..(62): LHUR01000005.1/88557-88496 Clostridium homopropionicum DSM 5847 CLHOM_contig000009, whole genome shotgun sequence
aactaaataggtgatgaagttcgccataatcatcctcatggattaatgacttctacaataag

SEQ ID NO: 688 - DNA, 107 bp, Burkholderia multivorans ATCC 17616
  misc_feature (1)..(107): AP009386.1/408531-408637 Burkholderia multivorans ATCC 17616 genomic DNA, complete genome, chromosome 2
ccgccttgcggagatggcatgcctccgtgcggcgttttcccgcgcatcgtgcgcgccggtccgctgctcaaccgccggttcgtccggctgatgatgcctgcgtgttc

SEQ ID NO: 689 - DNA, 73 bp, Clostridium sp. W14A NODE_46
  misc_feature (1)..(73): MBSV01000068.1/16190-16118 Clostridium sp. W14A NODE_46, whole genome shotgun sequence
cagatcattagggatgaagctccccttgaaaatgttcgaaatgctggaaacggctgatggcttctacaggaat

SEQ ID NO: 690 - DNA, 73 bp, Clostridium sp. MSTE9
  misc_feature (1)..(73): AKFU01000014.1/12710-12638 Clostridium sp. MSTE9 ctg120006482998, whole genome shotgun sequence
aatttttctgggaatgaagttctcccgcggcattgccgaaactgcttatttagctgatgacttctgcgctggc

SEQ ID NO: 691 - DNA, 61 bp, Acidobacteria bacterium
  misc_feature (1)..(61): MNGV01000003.1/10075-10135 Acidobacteria bacterium 13_1_40CM_3_55_6 13_1_40cm_3_scaffold_1207, whole genome shotgun sequence
agttctaccggcgatggagtccgccatcaaatgcctgcgtgctgatgactcctaccaaatc

SEQ ID NO: 692 - DNA, 65 bp, Vibro shilonii strain QT6D1
  misc_feature (1)..(65): CP018309.1/1749379-1749315 Vibro shilonii strain QT6D1 chromosome 2, complete sequence
tgcagccaaggtgatggggttccacctacttaaccgccaaatcggctgatgactcctacagtttc

SEQ ID NO: 693 - DNA, 67 bp, Enterococcus gilvus ATCC BAA-350
  misc_feature (1)..(67): KB946874.1/2597044-2596978 Enterococcus gilvus ATCC BAA-350 genomic scaffold acEQl-supercont1.3, whole genome shotgun sequence
tttggtaagagggatggtgctcccctcctaaccgctgactcaatcagctgatggcgcctgttataag

SEQ ID NO: 694 - DNA, 73 bp, Methylobacterium sp. Leaf399
  misc_feature (1)..(73): LMQK01000023.1/308864-308792 Methylobacterium sp. Leaf399 contig_3, whole genome shotgun sequence
atgcaccacggcaatggattctgccgggccacatggccgaaccgcccttcgggctgatgattcctaccttttg

SEQ ID NO: 695 - DNA, 65 bp, uncultured archaeon A07HR60
  misc_feature (1)..(65): KI543234.1/518618-518554 uncultured archaeon A07HR60 genomic scaffold scf7180000001783, whole genome shotgun sequence
gtctgttcaggcgatggagtccgcctgtcccaaccgccattctggctgatgactcctactgaaca

SEQ ID NO: 696 - DNA, 86 bp, Endozoicomonas montiporae strain LMG 24815
  misc_feature (1)..(86): JOKG01000001.1/596090-596005 Endozoicomonas montiporae strain LMG 24815 scaffold00001, whole genome shotgun sequence
atggctcagggtgatggagttccacctgctaaccgctcccatagctgattcacatagctttggcagctgatgactcctgtgtattg

SEQ ID NO: 697 - DNA, 80 bp, Acetobacter syzygii 9H-2
  misc_feature (1)..(80): BAMZ01000022.1/60532-60611 Acetobacter syzygii 9H-2 DNA, contig: Absy_022
actgagggtggcaatggactctgccggattttggtaaccaaaatcgaaccgccctgttggctgatgattcctaccccgca

SEQ ID NO: 698 - DNA, 70 bp, Providencia rettgeri DSM 1131
  misc_feature (1)..(70): GG705267.1/72722-72791 Providencia rettgeri DSM 1131 genomic scaffold Scfld5, whole genome shotgun sequence
aaacctttgggagatggcattcctccttatataaaaccgcccgtagagggctgatgatgcctacgttaac

SEQ ID NO: 699 - DNA, 73 bp, Acidobacteria bacterium
  misc_feature (1)..(73): MNJQ01000085.1/11364-11292 Acidobacteria bacterium 13_1_20CM_3_58_11 13_1_20cm_3_scaffold_5366, whole genome shotgun sequence
tttcgatttggcgatggagttcgccataaccgccccggtgatgttccccggtgctgatgactcctggcagccc

SEQ ID NO: 700 - DNA, 66 bp, Acidobacteria bacterium
  misc_feature (1)..(66): MEKW01000051.1/13961-14026 Acidobacteria bacterium RIFCSPLOWO2_02_FULL_68_18 rifcsplowo2_02_scaffold_3607, whole genome shotgun sequence
ccgagtgtcgggaatggtgtcaatcctaaaccacatcttgaagatgctgatgacgccttcggacac

SEQ ID NO: 701 - DNA, 65 bp, Spirochaetes bacterium
  misc_feature (1)..(65): MIAO01000077.1/1710-1646 Spirochaetes bacterium GWB1_36_13 gwb1_scaffold_2872, whole genome shotgun sequence
tttttatttggagatggagttctcccttaaaccgtcctgtaaagactgataactcctactaaaat

SEQ ID NO: 702 - DNA, 97 bp, Vibrio sp. JCM 19236
  misc_feature (1)..(97): BBSB01000017.1/87810-87906 Vibrio sp. JCM 19236 DNA, contig00017
gcgtcgaaaggtgatggggttccacctaattgaaccgccgaatcgttgaagcgcacagcgctgaacaaccctctcggctgatgactcctactaaaat

SEQ ID NO: 703 - DNA, 68 bp, Halanaerobium kushneri strain ATCC 700103
  misc_feature (1)..(68): FTNC01000013.1/57314-57247 Halanaerobium kushneri strain ATCC 700103 genome assembly, contig: Ga0104713_113
atgaattaaggggatggagctccccctttaaccactgttaaatagcagttgatggctcctatcttttt

SEQ ID NO: 704 - DNA, 71 bp, Pseudomonas fuscovaginae strain IRRI 6609
  misc_feature (1)..(71): JSYZ01000007.1/136286-136356 Pseudomonas fuscovaginae strain IRRI 6609 Pf_IRRI_6609_contig_7.7, whole genome shotgun sequence
cggcgctccggagatggcattcctccgttcccaaccgctgtgctgctgcagctgatgatgcctacagacac

SEQ ID NO: 705 - DNA, 59 bp, Cetobacterium somerae ATCC BAA-474
  misc_feature (1)..(59): KI518170.1/6377-6319 Cetobacterium somerae ATCC BAA-474 genomic scaffold Scaffold37, whole genome shotgun sequence
taataaataggcgatggagttcgccattaaacgcgaaagctaatgactcctactctttt

SEQ ID NO: 706 - DNA, 62 bp, Geobacillus sp. Y4.1MC1
  misc_feature (1)..(62): CP002293.1/2935878-2935817 Geobacillus sp. Y4.1MC1, complete genome.
ttaaaattaggcgatggggttcgccgtaattgccttttatggctgatgactcctaccagtaa

SEQ ID NO: 707 - DNA, 61 bp, Rhizobiales bacterium 63-22
  misc_feature (1)..(61): MKVZ01000019.1/51236-51296 Rhizobiales bacterium 63-22 SCNpilot_cont_500_bf_scaffold_96, whole genome shotgun sequence
atgatcgcagggaatggagtctcccgcagaccgcgccaccgctgatgactcctgccaatgg

SEQ ID NO: 708 - DNA, 68 bp, Thermodesulfovibrio sp. RBG_19FT_COMBO_42_12
  misc_feature (1)..(68): MIDI01000122.1/16449-16382 Thermodesulfovibrio sp. RBG_19FT_COMBO_42_12 rbg_19ft_combo_scaffold_289, whole genome shotgun sequence
tgaagtaaaggcgatggagttcgcttaatcgtcccgattaaatcgggaccgataactcctaccaccct

SEQ ID NO: 709 - DNA, 60 bp, Clostridium taeniosporum strain 1/k
  misc_feature (1)..(60): CP017253.1/1274876-1274817 Clostridium taeniosporum strain 1/k, complete genome
tatatattaggtgatggagttcgcctttaactgcttaatgctaatgactcctacaaaaac

SEQ ID NO: 710 - DNA, 66 bp, Drosophila ficusphila
  misc_feature (1)..(66): KB456680.1/1125-1190 Drosophila ficusphila unplaced genomic scaffold scf7180000450230, whole genome shotgun sequence
cgcggcacaggggatggggttcccccttataaccgcccgctcggggctgatgactcctgccgttat

SEQ ID NO: 711 - DNA, 72 bp, Dethiobacter alkaliphilus AHT 1
  misc_feature (1)..(72): ACJM01000018.1/29060-28989 Dethiobacter alkaliphilus AHT 1 ctg16, whole genome shotgun sequence
tttaattaaggcgatggagctcgccggggcattgcccaaaccgcacaatgtgctaatagctcctgccatgta

SEQ ID NO: 712 - DNA, 68 bp, Halococcus hamelinensis 100A6
  misc_feature (1)..(68): AOMB01000031.1/71848-71781 Halococcus hamelinensis 100A6 contig_31, whole genome shotgun sequence
gcttcatcgggcgatggagtccgcctgccccaaccgctgggtttccagctgatgactccttctccagc

SEQ ID NO: 713 - DNA, 76 bp, Thermococcus kodakarensis KOD1
  misc_feature (1)..(76): AP006878.1/440492-440567 Thermococcus kodakarensis KOD1 DNA, complete genome
ttcagcgcgggcgatggcgtccgcccggggcttcgagcccgaaccgctcgaaagggctgatgacgcctgttctact

SEQ ID NO: 714 - DNA, 68 bp, Thermotalea metallivorans strain B2-1
  misc_feature (1)..(68): LOEE01000028.1/49751-49818 Thermotalea metallivorans strain B2-1 AN619_contig000035, whole genome shotgun sequence
tttatcctaggtgatggagctcacctttaactattgcaaggaaggcaattgatggctcctgctataac

SEQ ID NO: 715 - DNA, 65 bp, Desulfatitalea sp. BRH_c12 BRHa_1002920
  misc_feature (1)..(65): LADR01000006.1/15176-15112 Desulfatitalea sp. BRH_c12 BRHa_1002920, whole genome shotgun sequence
aagttgatcggggatggagccccccgtataaccgcccgggctgggctgatgactcctaccggcag

SEQ ID NO: 716 - DNA, 61 bp, Alphaproteobacteria bacterium 65-37
  misc_feature (1)..(61): MKRV01000110.1/11303-11243 Alphaproteobacteria bacterium 65-37 SCNpilot_cont_300_bf_scaffold_2027, whole genome shotgun sequence
gtctccgatggggatggagtcccccgacaaccgccgcaaggctgatgactcctaccgaacg

SEQ ID NO: 717 - DNA, 76 bp, Eubacterium sp. CAG:581
  misc_feature (1)..(76): FR903093.1/21636-21561 Eubacterium sp. CAG:581 genomic scaffold, scf56
taacccttagggaatgaatgtctcccttagtattattacttaaactgctttttaagctgatgacttctgcattttg

SEQ ID NO: 718 - DNA, 61 bp, Candidatus Brocadia sinica JPN1
  misc_feature (1)..(61): BAFN01000001.1/1079928-1079988 Candidatus Brocadia sinica JPN1 DNA, contig: brosiA
taaaattcaggcgatggagttcgccaattgctatatgatagctgataactcctattgaagc

SEQ ID NO: 719 - DNA, 79 bp, Methanocella paludicola SANAE
  misc_feature (1)..(79): AP011532.1/2421352-2421430 Methanocella paludicola SANAE DNA, complete genome
acgtatatcggcgatgaagctcgccgtgctcttatgcagaaccgccgcacggactgcgactaatggcttctgttcgtta

SEQ ID NO: 720 - DNA, 106 bp, Burkholderia vietnamiensis G4 chromosome 2
  misc_feature (1)..(106): CP000615.1/985285-985390 Burkholderia vietnamiensis G4 chromosome 2, complete sequence
gccggctgcggagatggcatgcctccctgcggtcgagcacggcgcgttgcgcgcgcgagtcggccctcaaccgccggtgagcccggctgatgatgcctgcgtgttc

SEQ ID NO: 721 - DNA, 84 bp, Dethiosulfatibacter aminovorans DSM 17477
  misc_feature (1)..(84): FQZL01000032.1/30867-30950 Dethiosulfatibacter aminovorans DSM 17477 genome assembly, contig: EJ55DRAFT_scaffold00029.29
ataatataaggcgatggagttcgccaggcaagaaaacataacaagattgcctaaccgccaagtgctaatgactcctgttgactt

SEQ ID NO: 722 - DNA, 75 bp, Subdoligranulum sp. 4_3_54A2FAA
  misc_feature (1)..(75): JH414706.1/1587485-1587559 Subdoligranulum sp. 4_3_54A2FAA genomic scaffold supercont1.9, whole genome shotgun sequence
tccattacagggaatgaagttctcccttggattttatccaaaaccgcttttcaagctgatgacttctgcgatttt

SEQ ID NO: 723 - DNA, 67 bp, Candidimonas bauzanensis strain CGMCC 1.10190
  misc_feature (1)..(67): FQXE01000008.1/20864-20798 Candidimonas bauzanensis strain CGMCC 1.10190 genome assembly, contig: Ga0070552_108
gcacccaacggagatggcattcctccgctaaccgccgcgctctgcggctgatgatgcctacaagttc

SEQ ID NO: 724 - DNA, 82 bp, Nostoc sp. PCC 7120
  misc_feature (1)..(82): BA000019.2/2723228-2723309 Nostoc sp. PCC 7120 DNA, complete genome
attactaatggcgatggagttcgccaaaaccgctattctagtcaaaaaattaatctagaaggctgatgactcctacttttct

SEQ ID NO: 725 - DNA, 72 bp, Clostridium collagenovorans DSM 3089
  misc_feature (1)..(72): FQXP01000005.1/99007-98936 Clostridium collagenovorans DSM 3089 genome assembly, contig: EJ35DRAFT_scaffold00003.3
gagatatgaggagatgaagctctcctgataaactttatcaaactgctaaatgctaatagcttctacgacctg

SEQ ID NO: 726 - DNA, 77 bp, Gluconobacter oxydans H24
  misc_feature (1)..(77): CP003926.1/1806829-1806753 Gluconobacter oxydans H24, complete genome
ttcgagatcggcaatggactctgcctgacccgaacaaggtcgaaccgcccgcaagggctgatgattcctacctcgcc

SEQ ID NO: 727 - DNA, 61 bp, Bradyrhizobium sp. LTSP885 NODE_38
  misc_feature (1)..(61): JYMT01000038.1/519073-519133 Bradyrhizobium sp. LTSP885 NODE_38, whole genome shotgun sequence
cctgttgatggggatggagtcccccgataaccgccgcaaggctgatgactcctaccgggcg

SEQ ID NO: 728 - DNA, 66 bp, Candidatus Rokubacteria bacterium
  misc_feature (1)..(66): MNJV01000118.1/1655-1590 Candidatus Rokubacteria bacterium 13_1_20CM_2_70_7 13_1_20cm_2_scaffold_3979, whole genome shotgun sequence
aactgaaaaggtgatggggttcgcctaaaccgcccagaccatcgggctgatgacccctgccggacc

SEQ ID NO: 729 - DNA, 58 bp, Clostridium sulfidigenes strain 113A c22
  misc_feature (1)..(58): JPMD01000022.1/41832-41889 Clostridium sulfidigenes strain 113A c22, whole genome shotgun sequence
ataatttatggtgatggagttcaccttaatcgcaattgctaatgactcctacagacaa

SEQ ID NO: 730 - DNA, 61 bp, Paenibacillus sp. Y412MC10
  misc_feature (1)..(61): CP001793.1/4378898-4378958 Paenibacillus sp. Y412MC10, complete genome
attgaatgaggcgatggagttcgccataaccgcttccatagctaatgactcctaccagagg

SEQ ID NO: 731 - DNA, 78 bp, Photobacterium damselae subsp. piscicida DI21; identical to SEQ ID NO: 242
  misc_feature (1)..(78): KB405046.1/1712591-1712668 Photobacterium damselae subsp. piscicida DI21 genomic scaffold scaffold00001, whole genome shotgun sequence

SEQ ID NO: 732 - DNA, 69 bp, Syntrophobacterales bacterium
  misc_feature (1)..(69): MICJ01000091.1/301-369 Syntrophobacterales bacterium GWC2_56_13 gwc2_scaffold_5779, whole genome shotgun sequence
caaactggtggggatggagtcccccgctgaaaaatgcttcttaacagagctgatgactcctgccccgcc

SEQ ID NO: 733 - DNA, 73 bp, Paraburkholderia susongensis strain LMG 29540
  misc_feature (1)..(73): FXAT01000003.1/189831-189759 Paraburkholderia susongensis strain LMG 29540 genome assembly, contig: Ga0139082_103
gtcgaaatggtagatggcattcctccctgaatcgctgcttgcataggccgcagctgatgatgcctacagttcc

SEQ ID NO: 734 - DNA, 59 bp, Clostridium intestinale
  misc_feature (1)..(59): KI273145.1/1773152-1773210 Clostridium intestinale URNW genomic scaffold scaffold1, whole genome shotgun sequence
aaaaataaaggtgatggagttcaccataatcgctaaatgctaatgactcctataagtaa

SEQ ID NO: 735 - DNA, 68 bp, Chryseobacterium gleum ATCC 35910
  misc_feature (1)..(68): GL379781.1/3877121-3877188 Chryseobacterium gleum ATCC 35910 genomic scaffold SCAFFOLD1, whole genome shotgun sequence
aacaaaaaaggaaatggtgttcttccttacccaaccgctctaaaagagctgatgacgcctgattaaat

SEQ ID NO: 736 - DNA, 73 bp, Clostridium sp. CAG:307
  misc_feature (1)..(73): FR898703.1/17474-17546 Clostridium sp. CAG:307 genomic scaffold, scf82
aaatatttaggaaatgatgttcttccttgttatttaacaaaaccgctattatgctgatgacgtctatagtttt

SEQ ID NO: 737 - DNA, 62 bp, Butyricimonas synergistica isolate
  misc_feature (1)..(62): MNQW01000009.1/7224-7285 Butyricimonas synergistica isolate 43_13 Ley3_66761_scaffold_4522, whole genome shotgun sequence
ccaacttatggtaatggtatctacctcgaaccgcttgaaaagctgatgatgcctacatgtaa

SEQ ID NO: 738 - DNA, 63 bp, Bacteroides thetaiotaomicron VPI-5482
  misc_feature (1)..(63): AE015928.1/5995735-5995673 Bacteroides thetaiotaomicron VPI-5482, complete genome
ctttgcaccggctatgggattagcctttaaccgccctttggagctgatgatccctacaatttg

SEQ ID NO: 739 - DNA, 66 bp, Thermosulfidibacter takaii ABI70S6
  misc_feature (1)..(66): AP013035.1/752509-752574 Thermosulfidibacter takaii ABI70S6 DNA, complete genome
ctggctagaggcgatggagcccgcctttaaccgccgcactcagcggctgatggctcctacctcaaa

SEQ ID NO: 740 - DNA, 71 bp, Providencia rettgeri Dmel1 chromosome
  misc_feature (1)..(71): CM001774.1/2070305-2070375 Providencia rettgeri Dmel1 chromosome, whole genome shotgun sequence
atatatatgggagatggcattcctcctttttacaaaaccgcccgtagagggctaatgatgcctgcgttaac

SEQ ID NO: 741 - DNA, 62 bp, Pseudonocardia sp. HH130630-07
  misc_feature (1)..(62): CP013854.1/1763673-1763612 Pseudonocardia sp. HH130630-07, complete genome
cccggtgaaggcgatggagctcgccgacaaccgcacccgctgctgatggctcctaccgatcc

SEQ ID NO: 742 - DNA, 72 bp, Nocardia nova SH22a
  misc_feature (1)..(72): CP006850.1/5444076-5444147 Nocardia nova SH22a, complete genome
ctgagagcaggtgatggatcccgcccgggaaattcccgaaccgccacctcggctgatgggtcctgctggcgt

SEQ ID NO: 743 - DNA, 80 bp, Lentisphaerae bacterium
  misc_feature (1)..(80): MHBM01000161.1/11806-11885 Lentisphaerae bacterium RIFOXYA12_FULL_48_11 rifixya3_full_scaffold_335, whole genome shotgun sequence
tcctccccgagcgatggagttcgctcagaactgccctgatgaatctttgtgaactaagggatgatgactcctgctgtatc

SEQ ID NO: 744 - DNA, 79 bp, Clostridiales bacterium
  misc_feature (1)..(79): MNRF01000071.1/1702-1624 Clostridiales bacterium 42_27 Ley3_66761_scaffold_27397, whole genome shotgun sequence
agaataaacgggaatgaagttctcccgaagtaaccagattacttgaactgctttgaaagctgatgacttctgcgacgaa

SEQ ID NO: 745 - DNA, 70 bp, Flavobacterium sp. MedPE-SWcel Flavobacterium-sp-MedPE-SWcel-C5
  misc_feature (1)..(70): MPCW01000005.1/143348-143417 Flavobacterium sp. MedPE-SWcel Flavobacterium-sp-MedPE-SWcel-C5, whole genome shotgun sequence
actatcaatggcaatgatgtctgcctcgaaccgctttttataactagaagctgatgacgtctatttaatg

SEQ ID NO: 746 - DNA, 62 bp, Enterococcus canis strain DSM 17029
  misc_feature (1)..(62): JXKH01000002.1/476995-476934 Enterococcus canis strain DSM 17029 Scaffold2, whole genome shotgun sequence
tttcttgtaagggatggtgctcccgataaccgctaaaattagctgatggcgcctgttgtaag

SEQ ID NO: 747 - DNA, 69 bp, Thermanaerothrix daxensis strain GNS-1
  misc_feature (1)..(69): LGKO01000003.1/69724-69656 Thermanaerothrix daxensis strain GNS-1 contig_5, whole genome shotgun sequence
gcagcttgcggtgatgaggctcaccggagacccaaaccgcccatcagggctgatagcctctgtcgtttc

SEQ ID NO: 748 - DNA, 61 bp, Bacterium UASB14
  misc_feature (1)..(61): DF820455.1/1608747-1608687 Bacterium UASB14 DNA, scaffold: UASB14_scaffold_1
tttttattcggtgatggggttcaccgctaaccgccgacgtgctgataactcctaccagcgt

SEQ ID NO: 749 - DNA, 70 bp, Castellaniella defragrans 65Phen
  misc_feature (1)..(70): HG916765.1/3012383-3012452 Castellaniella defragrans 65Phen complete genome
ccctcatctggagatggcattcctccacgaaaccgccgcgcgcgccgcggctgatgatgcctacggcccc

SEQ ID NO: 750 - DNA, 76 bp, Cetobacterium ceti strain ATCC 700028
  misc_feature (1)..(76): FUWX01000006.1/107811-107886 Cetobacterium ceti strain ATCC 700028 genome assembly, contig: EI52DRAFT_scaffold00003.3
taataaagagggaatgaagttctcccttagttttgcaactaaaaccgcttatttagctgatgacttctacgacttt

SEQ ID NO: 751 - DNA, 64 bp, Lactobacillus rossiae DSM 15814
  misc_feature (1)..(64): AZFF01000008.1/81061-80998 Lactobacillus rossiae DSM 15814 Scaffold8, whole genome shotgun sequence
aacttaataggcgatgacgttcgccgcaaacaattattgataatttgatgacgtctactgcatg

SEQ ID NO: 752 - DNA, 60 bp, Alicyclobacillus ferrooxydans strain TC-34
  misc_feature (1)..(60): LJCO01000041.1/20596-20655 Alicyclobacillus ferrooxydans strain TC-34 contig_36, whole genome shotgun sequence
gttgtgaaaggtgatggagctcaccataaccgcctcgaggctaatggctcctgtggatga

SEQ ID NO: 753 - DNA, 60 bp, Paenibacillus stellifer strain DSM 14472
  misc_feature (1)..(60): CP009286.1/604006-604065 Paenibacillus stellifer strain DSM 14472, complete genome
ctgatgaacggcgatggagttcgccataaccgccgcaaggctgatgactcctaccagtgg

SEQ ID NO: 754 - DNA, 59 bp, Clostridia bacterium BRH_c25
  misc_feature (1)..(59): LOES01000122.1/5172-5114 Clostridia bacterium BRH_c25 BRHa_1003505, whole genome shotgun sequence
aatagttatggtgatggggctcaccataaccgctgtaagctgatggctcctattttgac

SEQ ID NO: 755 - DNA, 64 bp, Acidobacteria bacterium RIFCSPLOWO2_02_FULL_59_13
  misc_feature (1)..(64): MEKP01000380.1/13627-13564 Acidobacteria bacterium RIFCSPLOWO2_02_FULL_59_13 rifcsplowo2_02_scaffold_8252, whole genome shotgun sequence
taaatcttcggcgatggagttcgcccaaaccgtccggtcacggactgatgactcctggcggccc

SEQ ID NO: 756 - DNA, 64 bp, Photobacterium sp. 13-12 C2015
  misc_feature (1)..(64): MJIL01000045.1/762-825 Photobacterium sp. 13-12 C2015, whole genome shotgun sequence
ttagtaacgggtgatggagttccacctttaaccgctcgactgagatgatgactcctgctgtagt

SEQ ID NO: 757 - DNA, 100 bp, Eubacterium sp. CAG:76
  misc_feature (1)..(100): FR903040.1/40256-40157 Eubacterium sp. CAG:76 genomic scaffold, scf98
aatattactgggaatgaggttctcccaggaacgagatagaaatagccaaatttttcgttcataaccgcttgattataaagctgatgacttctgcaaagtg

SEQ ID NO: 758 - DNA, 80 bp, Methanocella paludicola SANAE
  misc_feature (1)..(80): AP011532.1/2434049-2434128 Methanocella paludicola SANAE DNA, complete genome
tcccatactggtgatgaagctcaccgtgctcttatgcagaaccgccgcaaggcaatgcgactaatagcttctccagacat

SEQ ID NO: 759 - DNA, 76 bp, Thermotogales bacterium
  misc_feature (1)..(76): LGGZ01000182.1/1820-1745 Thermotogales bacterium 46_20 MPJ_scaffold_5313, whole genome shotgun sequence
aattctctaggcaatgaagcttgccttggagaacagtcctccagaaccgccaccagctgatagcttctaccaaaat

SEQ ID NO: 760 - DNA, 67 bp, Bacteroides sp. 43_108
  misc_feature (1)..(67): MNQS01000021.1/67471-67537 Bacteroides sp. 43_108 Ley3_66761_scaffold_49, whole genome shotgun sequence
attaaaaaagggaatgggacttccctgttataaaccgctgaaaaaagctgatagttcctgttgagag

SEQ ID NO: 761 - DNA, 73 bp, Enterococcus sp. 8G7_MSG3316
  misc_feature (1)..(73): NGKU01000001.1/3091201-3091129 Enterococcus sp. 8G7_MSG3316 scaffold00001, whole genome shotgun sequence
ggagaataggggaatgaatgtctccctcagtgattactgaaaccgcaattttgctaatgacttctacaagctt

SEQ ID NO: 762 - DNA, 67 bp, Alicycliphilus denitrificans K601
  misc_feature (1)..(67): CP002657.1/360259-360193 Alicycliphilus denitrificans K601, complete genome
cggccgccaggagatggcgttcctcctgaaaccaccgcgtcgcgcggttgatgacgcctgcggagcc

SEQ ID NO: 763 - DNA, 61 bp, Paenibacillus sp. VKM B-2647
  misc_feature (1)..(61): JXAK01000060.1/37628-37688 Paenibacillus sp. VKM B-2647 B-2647_060, whole genome shotgun sequence
agcttatacggcgatggagttcgcctttaaccgcctttttgctaatgactcctaccagttt

SEQ ID NO: 764 - DNA, 65 bp, Desulfurella amilsii strain TR1
  misc_feature (1)..(65): MDSU01000018.1/319158-319094 Desulfurella amilsii strain TR1 opera_scaffold_1, whole genome shotgun sequence
ataatggcaggctatgaggttagcctttatacgctcttttttgagctgatgacctctacttttta

SEQ ID NO: 765 - DNA, 93 bp, Paraburkholderia tropica strain P-31
  misc_feature (1)..(93): LXGI01000116.1/46999-47091 Paraburkholderia tropica strain P-31 P31_contig_7, whole genome shotgun sequence
tcgtgcgcaggagatggcattcctcctgcattttccccaaccgccggaccggcagcgctgcttcctgctccggctgatgatgcctgcgagtcc

SEQ ID NO: 766 - DNA, 70 bp, Thiomonas intermedia K12
  misc_feature (1)..(70): CP002021.1/1823327-1823396 Thiomonas intermedia K12, complete genome
aaccattaaggcgatggagttcgccaaaaccgcgtggggctgcccccaagctaatgactcctacctgccg

SEQ ID NO: 767 - DNA, 62 bp, Oligotropha carboxidovorans OM5
  misc_feature (1)..(62): CP002826.1/2716030-2715969 Oligotropha carboxidovorans OM5, complete genome
attgttgatggggatggagttcccccgataaccgccgcaaggctgatgactcctaccggacg

SEQ ID NO: 768 - DNA, 70 bp, Methanosphaera stadtmanae DSM 3091
  misc_feature (1)..(70): CP000102.1/1672674-1672743 Methanosphaera stadtmanae DSM 3091, complete genome
aacaaataaggtgatgaggttccacctatttaactgccagtgattactggatgatgacttctatttttaa

SEQ ID NO: 769 - DNA, 67 bp, Herbaspirillum sp. YR522
  misc_feature (1)..(67): AKJA01000121.1/27981-28047 Herbaspirillum sp. YR522 PMI40_contig_322.322, whole genome shotgun sequence
attcggcccggagatggcattgctccccgaaccgccgcctgttgcggctgatcatgcctacggtgac

SEQ ID NO: 770 - DNA, 103 bp, Rhodanobacter sp. SCN 67-45
  misc_feature (1)..(103): MEFB01000036.1/3026-2924 Rhodanobacter sp. SCN 67-45 ABS82_C0036, whole genome shotgun sequence
ggcccgatgggagatggcatgcctcccgttgcgggcgcgcgacgcgtccgcaaccaaccaccccgggtgcttccgccacgaggttgatgatgcctgcaacgcc

SEQ ID NO: 771 - DNA, 77 bp, Sphingomonas sp. Leaf34
  misc_feature (1)..(77): LMLC01000004.1/376439-376515 Sphingomonas sp. Leaf34 contig_4, whole genome shotgun sequence
atcgactttggcaatggatttctgccgggcaatttggccgaaccgctctgataagagctgatgattcctacttggcg

SEQ ID NO: 772 - DNA, 67 bp, Geosporobacter subterraneus DSM 17957
  misc_feature (1)..(67): FQZV01000005.1/59151-59217 Geosporobacter subterraneus DSM 17957 genome assembly, contig: EJ58DRAFT_scaffold00003.3
tagaaagacggtgatggagctcacctttaagtattgcatccgtgcaattaatggctcctacttggct

SEQ ID NO: 773 - DNA, 80 bp, Deltaproteobacteria bacterium
  misc_feature (1)..(80): MGQI01000065.1/2753-2674 Deltaproteobacteria bacterium RBG_13_58_19 RBG_13_scaffold_17853, whole genome shotgun sequence
taaatagttggcgatggagtccgccggggtggagagggcatcacccaaaccgcattgatgctgatggctcctgatctcac

SEQ ID NO: 774 - DNA, 59 bp, Lactobacillus acidophilus NCFM
  misc_feature (1)..(59): CP000033.3/965933-965991 Lactobacillus acidophilus NCFM, complete genome
aagtaaaaaggtgatgacgttcaccgttaatcgagaaatctaatgacgtctactttatc

SEQ ID NO: 775 - DNA, 69 bp, Bacteroides sp. CAG:443
  misc_feature (1)..(69): FR887768.1/8595-8527 Bacteroides sp. CAG:443 genomic scaffold, scf45
cgaaatcaagggaatgggacttccctgttataaaccgctaattgaatagctgatagttcctgccggagt

SEQ ID NO: 776 - DNA, 76 bp, Methylacidiphilum infernorum V4
  misc_feature (1)..(76): CP000975.1/1995740-1995815 Methylacidiphilum infernorum V4, complete genome
ctcttattgggcgatggggctcgccgaccgttaaccgccgttcttttcaaagaaggctgatagctcctacctctaa

SEQ ID NO: 777 - DNA, 63 bp, Sporomusa sphaeroides DSM 2875
  misc_feature (1)..(63): LSLJ01000003.1/344447-344509 Sporomusa sphaeroides DSM 2875 SPSPH_contig000003, whole genome shotgun sequence
aaagtttggggcgatggagttcgcccgaatcctggctggccaggtgatgactcctaccgtaaa

SEQ ID NO: 778 - DNA, 64 bp, Vibrio maritimus
  misc_feature (1)..(64): BBMT01000001.1/428748-428811 Vibrio maritimus DNA, contig: contig00001, strain: JCM 19240
tgtcatcaaggtgatggggttccacctacttaaccgccaactggctgatgactcctacagtttc

SEQ ID NO: 779 - DNA, 59 bp, Clostridium botulinum A str. ATCC 3502
  misc_feature (1)..(59): AM412317.1/1975371-1975313 Clostridium botulinum A str. ATCC 3502 complete genome
ttaaatataggcgatggagttcgccataattgcgtaatgctaatgactcctacaaataa

SEQ ID NO: 780 - DNA, 67 bp, Acinetobacter sp. ADP1
  misc_feature (1)..(67): CR543861.1/406046-406112 Acinetobacter sp. ADP1 complete genome
cgacagataggagatgacattcctcctcgcaaaaaccgccgttctggctaatgatgtctacgttacc

SEQ ID NO: 781 - DNA, 71 bp, Alistipes sp. An31A
  misc_feature (1)..(71): NFIO01000003.1/155466-155536 Alistipes sp. An31A An31A_contig_3, whole genome shotgun sequence
agccgcaaaggcaatggtatctgcctcaaaccgccgcccgttcgggatgtgctgatgatacctgcataaac

SEQ ID NO: 782 - DNA, 66 bp, Burkholderia sp. TJI49
  misc_feature (1)..(66): AEXE01000085.1/4565-4500 Burkholderia sp. TJI49 contig072.1, whole genome shotgun sequence
agctgaaacggagatggcattcctccaaaaccgccggtatctccggctgatgatgcctacggattc

SEQ ID NO: 783 - DNA, 64 bp, Burkholderiales bacterium 70-64
  misc_feature (1)..(64): MKUQ01000030.1/7789-7852 Burkholderiales bacterium 70-64 SCNpilot_expt_1000_bf_scaffold_318, whole genome shotgun sequence
gctgtcagtggagatggcatacctcccttaaccgccggtcacggctgatgatgcctacgcaagg

SEQ ID NO: 784 - DNA, 76 bp, Nostoc sp. PCC 7107
  misc_feature (1)..(76): CP003548.1/698262-698337 Nostoc sp. PCC 7107, complete genome
aagaacagtggtgatgaaactcgccttctggaataaccagaaaaccgcctgtggggctgatagtttctagttcaat

SEQ ID NO: 785 - DNA, 64 bp, Serratia fonticola strain DSM 4576
  misc_feature (1)..(64): CP011254.1/3454057-3453994 Serratia fonticola strain DSM 4576, complete genome
ccaacaaacggagatgacattcctccataaccgcctttcacaggctgatgatgtctacgtaacc

SEQ ID NO: 786 - DNA, 61 bp, Bradyrhizobium erythrophlei strain GAS478
  misc_feature (1)..(61): FSRD01000001.1/3621429-3621489 Bradyrhizobium erythrophlei strain GAS478 genome assembly, contig: Ga0132009_11
catcccgatggggatggggtcccccgataaccgccgcaaggctgatgactcctgccaggcg

SEQ ID NO: 787 - DNA, 77 bp, Methanobrevibacter arboriphilus JCM 13429 = DSM 1125 strain DH1
  misc_feature (1)..(77): JXMW01000003.1/205756-205832 Methanobrevibacter arboriphilus JCM 13429 = DSM 1125 strain DH1 MBBAR_3c, whole genome shotgun sequence
atacagtaaggtgatgaggttccacctataactgccattttttttaaaaaaatctggatgatgacttctactatcaa

SEQ ID NO: 788 - DNA, 68 bp, Enterococcus durans ATCC 6056
  misc_feature (1)..(68): KE136516.1/288643-288710 Enterococcus durans ATCC 6056 genomic scaffold acyDB-supercont2.4, whole genome shotgun sequence
aagtgaataggtgatggtgttcgcctttaaacgttgatcgtaagataactaatgacgcctactaaaga

SEQ ID NO: 789 - DNA, 61 bp, Candidatus Methanoperedens nitroreducens strain ANME-2d
  misc_feature (1)..(61): JMIY01000007.1/448820-448880 Candidatus Methanoperedens nitroreducens strain ANME-2d ANME2D_Contig_7.7, whole genome shotgun sequence
atagaaacaggtgatggagttcaccttcaaccgcttgatagctgataactcctaccgatca

SEQ ID NO: 790 - DNA, 63 bp, Paenibacillus riograndensis SBR5 isolate SBR5(T)
  misc_feature (1)..(63): LN831776.1/1329372-1329310 Paenibacillus riograndensis SBR5 isolate SBR5(T) genome assembly, chromosome: I
attcaatacggcgatggagttcgccattaaccgtccctagagactaatgactcctaccagcgg

SEQ ID NO: 791 - DNA, 75 bp, Thermococcus sp. 5-4
  misc_feature (1)..(75): CP021848.1/831245-831319 Thermococcus sp. 5-4, complete genome
ggtctttcgggcgatggcgtccgcccgggcttcgagccgaaccgcccgtcgagggctgatgacgcctgttctccg

SEQ ID NO: 792 - DNA, 62 bp, Betaproteobacteria bacterium
  misc_feature (1)..(62): MERQ01000020.1/82209-82148 Betaproteobacteria bacterium RIFCSPLOWO2_12_FULL_68_20 rifcsplowo2_12_scaffold_1499, whole genome shotgun sequence
gcgaagcagggagatggcattcctcccataaccgccgcaaggctgatgatgcctacgcgaga

SEQ ID NO: 793 - DNA, 72 bp, Deltaproteobacteria bacterium
  misc_feature (1)..(72): MGRA01000126.1/7329-7258 Deltaproteobacteria bacterium RBG_19FT_COMBO_46_12 rbg_19ft_combo_scaffold_1869, whole genome shotgun sequence
atcgacagaggcgatgaggttcgcctttaactgtccttttgttgagaaaggactgataacttctaccgggtt

SEQ ID NO: 794 - DNA, 91 bp, Rhodanobacter sp. SCN 69-32
  misc_feature (1)..(91): MEGJ01000001.1/237916-238006 Rhodanobacter sp. SCN 69-32 ABT17_C0001, whole genome shotgun sequence
ctccatgagggagatggcatgcctcccgttccccggcggaacgaaccgccccgcacgacccatcgcaggggctgatgatgcctgcaccacc

SEQ ID NO: 795 - DNA, 62 bp, Paenibacillus sp. JCM 10914 DNA
  misc_feature (1)..(62): BAUO01000002.1/383903-383842 Paenibacillus sp. JCM 10914 DNA, contig: contig_2
atcaaatgaggcgatggagttcgccataaccgctgtttgcagctaatgactcctaccagagg

SEQ ID NO: 796 - DNA, 61 bp, Mycobacterium sp. NE-TNMC-100812
  misc_feature (1)..(61): MLQM01000022.1/19259-19199 Mycobacterium sp. NE-TNMC-100812 PROKKA_contig000022, whole genome shotgun sequence
tcgaggtcaggcgatggagttcgcctcaactgccacaccggctgatggcttctacgacgtg

SEQ ID NO: 797 - DNA, 67 bp, Candidimonas bauzanensis strain CGMCC 1.10190; identical to SEQ ID NO: 553
  misc_feature (1)..(67): FQXE01000008.1/6418-6352 Candidimonas bauzanensis strain CGMCC 1.10190 genome assembly, contig: Ga0070552_108

SEQ ID NO: 798 - DNA, 78 bp, Elusimicrobia bacterium GWC2_61_19
  misc_feature (1)..(78): MGUD01000025.1/66406-66329 Elusimicrobia bacterium GWC2_61_19 gwc2_scaffold_560, whole genome shotgun sequence
gcgtcccccggcgatgatgtccgccgccctgtaaagacagggaaaccgtccgcagggactaatgacctctactcaagg

SEQ ID NO: 799 - DNA, 69 bp, Candidatus Handelsmanbacteria bacterium
  misc_feature (1)..(69): MFKF01000231.1/5169-5237 Candidatus Handelsmanbacteria bacterium RIFCSPLOWO2_12_FULL_64_10 rifcsplowo2_12_scaffold_31199, whole genome shotgun sequence
tcgcctgcgggagatggcattcctcccgtaaaaagaaccgccggcccggctgatgatgcctacgtgatc

SEQ ID NO: 800 - DNA, 71 bp, Leptospirillum ferriphilum ML-04
  misc_feature (1)..(71): CP002919.1/1745084-1745154 Leptospirillum ferriphilum ML-04, complete genome
aggaagacaggcgatggggttcgccaaaaccgccccggagaacagcgggagctgatgacccctactccatt

SEQ ID NO: 801 - DNA, 62 bp, Mesorhizobium sp. SOD10
  misc_feature (1)..(62): CCNA01000034.1/638081-638020 Mesorhizobium sp. SOD10 genome assembly, contig: MPLSOD_Contig_4
ctcaaaaatggggatggggttcccccgaaaccgcccttgtggctgatgactcctgccaggcg

SEQ ID NO: 802 - DNA, 65 bp, Shinella sp. HZN7
  misc_feature (1)..(65): CP015736.1/1032604-1032668 Shinella sp. HZN7, complete genome
gtgtgggatggggatggagctccccgacaactgccgtgtgaccggctgatagctcctgccaagac

SEQ ID NO: 803 - DNA, 74 bp, Chitinophaga eiseniae strain DSM 22224
  misc_feature (1)..(74): FUWZ01000006.1/324561-324634 Chitinophaga eiseniae strain DSM 22224 genome assembly, contig: Ga0070509_106
tgcgacacaggaaatggtgtcttcctgctcagaaccgttccgggtcctccggaactgatggcgcctacaaaaca

SEQ ID NO: 804 - DNA, 63 bp, Serratia sp. Leaf50
  misc_feature (1)..(63): LMLI01000016.1/324384-324322 Serratia sp. Leaf50 contig_4, whole genome shotgun sequence
aaagctgttggagatgacattcctcccaaaccgccttcaccggctgatgatgtctacgaaatc

SEQ ID NO: 805 - DNA, 74 bp, Thermococcus celer strain Vu 13
  misc_feature (1)..(74): CP014854.1/931547-931620 Thermococcus celer strain Vu 13, complete genome
gttccaccgggcgatggcgtccgcccgggcttcgagccgaaccgccctccagggctgatgacgcctgttctccg

SEQ ID NO: 806 - DNA, 60 bp, Carboxydothermus hydrogenoformans Z-2901
  misc_feature (1)..(60): CP000141.1/1888854-1888795 Carboxydothermus hydrogenoformans Z-2901, complete genome
aaatttaatggcgatggggctcgcctaacgctcatctgagctaatagctcctaccgaaag

SEQ ID NO: 807 - DNA, 76 bp, Dorea longicatena CAG:42
  misc_feature (1)..(76): FR898362.1/2736-2661 Dorea longicatena CAG:42 genomic scaffold, scf181
cttttagaagggaatgaagttctcccttagtgatcatactagaaccgcttataaagctgatgacttctgcgaataa

SEQ ID NO: 808 - DNA, 67 bp, Acinetobacter brisouii CIP 110357
  misc_feature (1)..(67): KI530763.1/81247-81181 Acinetobacter brisouii CIP 110357 genomic scaffold adgTE-supercont2.2, whole genome shotgun sequence
acctgatcaggagatggcattcctcctgtaacaaaccgccatatcggctaatgatgcctacgtcacc

SEQ ID NO: 809 - DNA, 65 bp, Mucilaginibacter lappiensis strain ATCC BAA-1855
  misc_feature (1)..(65): FTMG01000002.1/526443-526507 Mucilaginibacter lappiensis strain ATCC BAA-1855 genome assembly, contig: Ga0104715_102
cgtatcaaaggaaatggtgtcttcctacttaaccgccctgaaaagctgatggcgcctacaatgaa

SEQ ID NO: 810 - DNA, 72 bp, Williamsia sp. Leaf354
  misc_feature (1)..(72): LMPL01000001.1/915709-915780 Williamsia sp. Leaf354 contig_1, whole genome shotgun sequence
gacgaacacggtgatggatcccgccggagcatctgctcgaaccgccacacggctgatggttcctacccatgt

SEQ ID NO: 811 - DNA, 68 bp, Acinetobacter rudis CIP 110305
  misc_feature (1)..(68): KE340353.1/613687-613620 Acinetobacter rudis CIP 110305 genomic scaffold acVBL-supercont1.4, whole genome shotgun sequence
attaacaaaggagatggtaatcctccttaaacaaaccgccaattctggctgatgatgcctacgtttcc

SEQ ID NO: 812 - DNA, 71 bp, Roseburia sp. 831b
  misc_feature (1)..(71): MJHW01000002.1/695258-695328 Roseburia sp. 831b contig000002, whole genome shotgun sequence
aaattgacagggaatgaagttctcccttgggaaacctaaactgcttattggctgatgacttctacgattat

SEQ ID NO: 813 - DNA, 75 bp, Mycobacterium xenopi RIVM700367; identical to SEQ ID NO: 526
  misc_feature (1)..(75): AJFI01000022.1/152647-152573 Mycobacterium xenopi RIVM700367 contig22, whole genome shotgun sequence

SEQ ID NO: 814 - DNA, 64 bp, Clostridia bacterium
  misc_feature (1)..(64): LGFR01000150.1/2134-2071 Clostridia bacterium 62_21 S_scaffold_2037, whole genome shotgun sequence
ggttccacaggcgatggggttcgcctgaactaccgcgcgagcggttgataacccctacctgaac

SEQ ID NO: 815 - DNA, 73 bp, Pseudomonas fluorescens SBW25
  misc_feature (1)..(73): AM181176.4/2081856-2081784 Pseudomonas fluorescens SBW25 complete genome
cggctcattggagatggcattcctccattaaccaaccgctgtgcccgtagcagctgatgatgcctacagaaac

SEQ ID NO: 816 - DNA, 70 bp, Ornatilinea apprima strain P3M-1
  misc_feature (1)..(70): LGCL01000023.1/39163-39094 Ornatilinea apprima strain P3M-1 contig_9, whole genome shotgun sequence
atatcaataagcgatgaggctcgctcaaaagatataaatcgctcaaacagctaatggcctctaccaggtt

SEQ ID NO: 817 - DNA, 89 bp, Ricinus communis cultivar Hale
  misc_feature (1)..(89): AASG02041893.1/549-637 Ricinus communis cultivar Hale ctg_1100012285214, whole genome shotgun sequence
aaatccaacggtaatggatttctgccgggccttggtggccgaaccgctgctctgattttcccagggaagctgatgactcctactcaaca

SEQ ID NO: 818 - DNA, 75 bp, Mycobacterium heidelbergense strain DSM 44471
  misc_feature (1)..(75): MVHR01000005.1/163180-163106 Mycobacterium heidelbergense strain DSM 44471 NODE_5_length_243907_cov_56.1658, whole genome shotgun sequence
tggtcgcgaggcgatggatctccgcctgggtaatccgcccaaaccgccggcccggctgatggctcctgtggtgct

SEQ ID NO: 819 - DNA, 67 bp, Candidimonas bauzanensis strain CGMCC 1.10190; identical to SEQ ID NO: 723
  misc_feature (1)..(67): FQXE01000023.1/20864-20798 Candidimonas bauzanensis strain CGMCC 1.10190 genome assembly, contig: Ga0070552_123

SEQ ID NO: 820 - DNA, 83 bp, Leifsonia sp. Root227
  misc_feature (1)..(83): LMIO01000004.1/100573-100491 Leifsonia sp. Root227 contig_4, whole genome shotgun sequence
tgggcggacggcgatggatctcgcctgggcagcacccgtgccgtgcccgaaccgcgtcgtccgctgatagttcctacgcttcc

SEQ ID NO: 821 - DNA, 60 bp, Geobacillus sp. WCH70
  misc_feature (1)..(60): CP001638.1/886398-886457 Geobacillus sp. WCH70, complete genome
agagtaataggcgatggagttcgctaaactatcgttcgggctgatgactcctaccagtaa

SEQ ID NO: 822 - DNA, 104 bp, Rhodanobacter sp. Soil772
  misc_feature (1)..(104): LMSK01000001.1/52013-51910 Rhodanobacter sp. Soil772 contig_1, whole genome shotgun sequence
ggccgcgcgggagatggcatgcctcccgttccggagcctgcgggcacaccgggacaaaccgcttctcgtgatcccgcgttgaagttgatgatgcctgctccccc

SEQ ID NO: 823 - DNA, 63 bp, Bacteroidetes bacterium
  misc_feature (1)..(63): MENT01000026.1/88105-88167 Bacteroidetes bacterium GWD2_45_23 gwd2_scaffold_79, whole genome shotgun sequence
aacatttttggcgatggtattcgccctaaaccgccagttttggctaataatacctactaataa

SEQ ID NO: 824 - DNA, 116 bp, Bifidobacterium subtile strain LMG 11597
  misc_feature (1)..(116): JGZR01000003.1/181277-181162 Bifidobacterium subtile strain LMG 11597 Contig03, whole genome shotgun sequence
gggcagaacggtgatgggccccgcctggacgcatgtccgaaccgcacagtgttgacaagcatggcgttgatgaatgcaatgccgacaaacacagtgctgatggttcctactcaatc

SEQ ID NO: 825 - DNA, 72 bp, Paraburkholderia susongensis strain LMG 29540
  misc_feature (1)..(72): FXAT01000003.1/191226-191297 Paraburkholderia susongensis strain LMG 29540 genome assembly, contig: Ga0139082_103
gatttttgcggagatggcattcctccctaactgccgctagcaagctttgcggctaatgatgcctacagggtc

SEQ ID NO: 826 - DNA, 94 bp, Frateuria sp. Soil773
  misc_feature (1)..(94): LMSL01000010.1/6484-6391 Frateuria sp. Soil773 contig_18, whole genome shotgun sequence
gtcgcacagggagatggcatgcctcccgttccctcgtggaacgaaccgccccacgccttgaccgatcgacggggttgatgatgcctgcatcacc

SEQ ID NO: 827 - DNA, 64 bp, Candidatus Schekmanbacteria bacterium GWA2_38_11
  misc_feature (1)..(64): MGDB01000134.1/599-662 Candidatus Schekmanbacteria bacterium GWA2_38_11 gwa2_scaffold_6985, whole genome shotgun sequence
cctgaaaatggcgatggggttcgccaataaccatccataatggattgatgacccctactgaaac

SEQ ID NO: 828 - DNA, 61 bp, Acidithrix ferrooxidans strain Py-F3 AXFE
  misc_feature (1)..(61): JXYS01000110.1/6185-6245 Acidithrix ferrooxidans strain Py-F3 AXFE_contig000110, whole genome shotgun sequence
ttatggactggcgatggagttcgccataactgccacaatggctaataactcctacatagcg

SEQ ID NO: 829 - DNA, 78 bp, Coprococcus sp. CAG:782
  misc_feature (1)..(78): HF991186.1/156700-156777 Coprococcus sp. CAG:782 genomic scaffold, scf290
tatagaccagggaatgaggcactcccttgacaagatttgtctaaaccgcccgaaatggctgatggcttctgcatttta

SEQ ID NO: 830 - DNA, 68 bp, Candidatus Bathyarchaeota archaeon
  misc_feature (1)..(68): MEZG01000067.1/124-191 Candidatus Bathyarchaeota archaeon RBG_13_60_20 RBG_13_scaffold_5248, whole genome shotgun sequence
cttgatcgaggcgatgaggctcgcctttaaccgccctctcggtgaggactgacagcttctacacaaac

SEQ ID NO: 831 - DNA, 67 bp, Deltaproteobacteria bacterium
  misc_feature (1)..(67): MGQO01000116.1/9048-9114 Deltaproteobacteria bacterium RBG_16_47_11 RBG_16_scaffold_21686, whole genome shotgun sequence
ttgaaacctggcgatgaagttcgccttaaatgtccccacggaagggaatgataacttctactggtta

SEQ ID NO: 832 - DNA, 62 bp, Megasphaera cerevisiae DSM 20462
  misc_feature (1)..(62): LEKT01000054.1/20510-20571 Megasphaera cerevisiae DSM 20462 scaffold_53, whole genome shotgun sequence
aatttcataggcgatggagttcgcctgtacatgactatcgtgttgatgactcctacctttta

SEQ ID NO: 833 - DNA, 62 bp, Lactobacillus floricola DSM 23037 = JCM
  misc_feature (1)..(62): AYZL01000008.1/51973-52034 Lactobacillus floricola DSM 23037 = JCM 16512 strain DSM 23037 NODE_14, whole genome shotgun sequence
aaaataaacggtgatggtgttcgccattaaatgcaagtattgctgatgacacctgttgaagc

SEQ ID NO: 834 - DNA, 79 bp, Gluconacetobacter sp. SXCC-1
  misc_feature (1)..(79): AFCH01000049.1/79202-79124 Gluconacetobacter sp. SXCC-1 Contig2957, whole genome shotgun sequence
aatacgggcggcaatggactctgcctgatttcagtgatgaaatcgaaccgcccgccgggctgatgattcctaccccgcc

SEQ ID NO: 835 - DNA, 80 bp, Clostridium symbiosum WAL-14163
  misc_feature (1)..(80): GL834309.1/286554-286475 Clostridium symbiosum WAL-14163 genomic scaffold supercont1.5, whole genome shotgun sequence
aatacagtcgggaatgaagttctcccccagtattgtttatactgaaaccgcttatttgagctgatgacttctgcggatac

SEQ ID NO: 836 - DNA, 74 bp, Enterococcus canis strain DSM 17029
  misc_feature (1)..(74): JXKH01000005.1/130635-130562 Enterococcus canis strain DSM 17029 Scaffold5, whole genome shotgun sequence
tctaggacagggaatgaggttctcccttggttcatacctaaactgcttacaaagctgatgacttctgtttttta

SEQ ID NO: 837 - DNA, 62 bp, Clostridium fallax strain DSM 2631
  misc_feature (1)..(62): FQVM01000008.1/12844-12783 Clostridium fallax strain DSM 2631 genome assembly, contig: Ga0131101_108
attttaataggttatggagttaaccgtaaaccgcgaaaaaagctgatgactcctacataaaa

SEQ ID NO: 838 - DNA, 74 bp, Methylobacterium platani strain SE2.11
  misc_feature (1)..(74): JTHF01000066.1/5252-5325 Methylobacterium platani strain SE2.11 contig_66, whole genome shotgun sequence
caccgtcacggcaatggatttctgccgggccatcgtggccgaaccgccctcgggctgatgattcctaccttttg

SEQ ID NO: 839 - DNA, 62 bp, Desulfurella acetivorans A63
  misc_feature (1)..(62): CP007051.1/592759-592698 Desulfurella acetivorans A63, complete genome
tacaaaagtggcgatggagttcgccaaaaatgcctacctaggctgataactcctacaaatta

SEQ ID NO: 840 - DNA, 62 bp, Rhodanobacter sp. SCN 68-63
  misc_feature (1)..(62): MEGL01000229.1/173-112 Rhodanobacter sp. SCN 68-63 ABT19_C0229, whole genome shotgun sequence
tgacagatgggagatggcatgcctccccgaaccgccgcaaggctgatgatgcctggttgacc

SEQ ID NO: 841 - DNA, 77 bp, Ilyobacter polytropus DSM 2926
  misc_feature (1)..(77): CP002282.1/640124-640200 Ilyobacter polytropus DSM 2926 plasmid pILYOP01, complete sequence
aaataaaagggggatgaagctctcccggaaaaattccaaatgcttctaattacggagatgatggcttctacagaaaa

SEQ ID NO: 842 - DNA, 71 bp, Leptolinea tardivitalis strain YMTK-2
  misc_feature (1)..(71): LGCK01000014.1/708435-708365 Leptolinea tardivitalis strain YMTK-2 contig_1, whole genome shotgun sequence
aatcaattaagcgatgaagctcgctcggaaataatcaaactgtctttatggctgatagcttctgccttaaa

SEQ ID NO: 843 - DNA, 64 bp, Kozakia baliensis strain DSM 14400
  misc_feature (1)..(64): CP014674.1/1095373-1095310 Kozakia baliensis strain DSM 14400, complete genome
cgagacaaaggagatggggttcctccttgtaaccgcccgtagggctgatgactcctattcgatt

SEQ ID NO: 844 - DNA, 61 bp, Pseudobacteroides cellulosolvens ATCC 35603 = DSM 2933 ctg1
  misc_feature (1)..(61): LGTC01000001.1/6340601-6340661 Pseudobacteroides cellulosolvens ATCC 35603 = DSM 2933 ctg1, whole genome shotgun sequence
aattaaataggtgatggagttcgccattaactgctactatgctaatgactcctacataatt

SEQ ID NO: 845 - DNA, 65 bp, Streptomyces atratus strain OK807
  misc_feature (1)..(65): FPJO01000018.1/52009-51945 Streptomyces atratus strain OK807 genome assembly, contig: Ga0007934_1018
gacacatcgggcgatgaggctcgccgtaaccgcgccgatgcggcgctgatgacctctgcgtgacc

SEQ ID NO: 846 - DNA, 74 bp, Herbaspirillum seropedicae SmR1
  misc_feature (1)..(74): CP002039.1/2800602-2800675 Herbaspirillum seropedicae SmR1, complete genome
tgcgccgcaggagatggcattcctcctcaaaccgccgccaagtccagcttggggctgatgatgcctacagtgac

SEQ ID NO: 847 - DNA, 62 bp, [Clostridium] sordellii strain JGS6382
  misc_feature (1)..(62): LN681234.1/1342269-1342208 [Clostridium] sordellii strain JGS6382 genome assembly, chromosome: 1
aaacaaatcggcgatggagttcgccattaaatgcacaagatgctaatgactcctactcttat

SEQ ID NO: 848 - DNA, 62 bp, Bacterium UASB270
  misc_feature (1)..(62): DF820472.1/170173-170112 Bacterium UASB270 DNA, scaffold: UASB270_scaffold_10
gtagtatcaggtgatggagttcacctcaaaccgcatgttctgctgataactcctaccaattt

SEQ ID NO: 849 - DNA, 63 bp, Acidiferrobacter thiooxydans strain ZJ
  misc_feature (1)..(63): MDCF01000005.1/56436-56498 Acidiferrobacter thiooxydans strain ZJ Contig_102, whole genome shotgun sequence
cgtcttgcgggagatggcagcctacctataaccgccctcgcggctgatgatgcctacgatttc

SEQ ID NO: 850 - DNA, 74 bp, Streptomyces nodosus strain ATCC 14899
  misc_feature (1)..(74): CP009313.1/1026203-1026276 Streptomyces nodosus strain ATCC 14899 genome
ggagggggtggcgatgaggctcgccgcaaccgcacgaccggagcaccgaccgtgctgatggcctctccctgacg

SEQ ID NO: 851 - DNA, 66 bp, Candidatus Methanoregula boonei 6A8
  misc_feature (1)..(66): CP000780.1/914829-914764 Candidatus Methanoregula boonei 6A8, complete genome
ttttttaacggcgatgaagtccgcctccaaccgccacgtatcgtgactgatgacttctaccgggga

SEQ ID NO: 852 - DNA, 67 bp, Lactobacillus composti DSM 18527 = JCM 14202 strain DSM 18527
  misc_feature (1)..(67): AZGA01000066.1/29758-29824 Lactobacillus composti DSM 18527 = JCM 14202 strain DSM 18527 NODE_114, whole genome shotgun sequence
aagttaataggcgatgatgttcgccataaaataattgttcaaacaatttgatgacgtctactgtaat

SEQ ID NO: 853 - DNA, 64 bp, Streptomyces nanshensis strain SCSIO 10429
  misc_feature (1)..(64): LJGW01000451.1/13279-13342 Streptomyces nanshensis strain SCSIO 10429 scaffold449, whole genome shotgun sequence
cagtgtgcaggtgatggggctcaccgcaaccgcggcctgtgccgctgacggtccctggtccacg

SEQ ID NO: 854 - DNA, 74 bp, Clostridiales bacterium 36_14
  misc_feature (1)..(74): MNRC01000242.1/4607-4680 Clostridiales bacterium 36_14 Ley3_66761_scaffold_11528, whole genome shotgun sequence
aaagagaaagggaatgaagttctccctcgaagagattcgaaaccgcttattaagctgatgacttctgtgtaatg

SEQ ID NO: 855 - DNA, 71 bp, Acidobacteria bacterium
  misc_feature (1)..(71): MNJR01000078.1/16660-16590 Acidobacteria bacterium 13_1_20CM_3_53_8 13_1_20cm_3_scaffold_30, whole genome shotgun sequence
cactacataggcgatggagttcgccacataaccgtcctgtttttgacagggctgataactcctggtcatat

SEQ ID NO: 856 - DNA, 103 bp, Burkholderia andropogonis strain ICMP2807
  misc_feature (1)..(103): LAQU01000008.1/136473-136575 Burkholderia andropogonis strain ICMP2807 contig00008, whole genome shotgun sequence
agccgcgcaggagatggtgctcctcctggtttagacaaaccgccccgtcgatcgctgaatatattattccgcaggacgcgaggccgatggcgcctacagtttc

SEQ ID NO: 857 - DNA, 63 bp, Gemmatimonadetes bacterium
  misc_feature (1)..(63): MNHH01000267.1/1038-976 Gemmatimonadetes bacterium 13_1_40CM_2_60_3 13_1_40cm_2_scaffold_105334, whole genome shotgun sequence
ctttcagcaggcgatggagttcgccttcaaccgcccattcgggctgatgactcctaccgaata

SEQ ID NO: 858 - DNA, 76 bp, Thermococcus gammatolerans EJ3
  misc_feature (1)..(76): CP001398.1/1580180-1580105 Thermococcus gammatolerans EJ3, complete genome
aggtggttgggcgatggcgtccgcccggggcttcgggcccgaaccgcccgtaggggctgatgacgcctgttctccg

SEQ ID NO: 859 - DNA, 76 bp, Pantoea sp. At-9b
  misc_feature (1)..(76): CP002433.1/4140667-4140592 Pantoea sp. At-9b, complete genome
cccccttaaggtgatggcgtgccaccttccccaaccgccgttctggcaacagacggctgatgacgcctgacaacac

SEQ ID NO: 860 - DNA, 71 bp, Methanosarcina barkeri str. Fusaro
  misc_feature (1)..(71): CP000099.1/4790369-4790299 Methanosarcina barkeri str. Fusaro, complete genome
tatcctataggtgatgaagtccgccaagatttacagtctaaaccgcttatgctgatgacttctacattaat

SEQ ID NO: 861 - DNA, 76 bp, Hymenobacter sedentarius strain DG5B chromosome
  misc_feature (1)..(76): CP013909.1/4555498-4555573 Hymenobacter sedentarius strain DG5B chromosome, complete genome
tccaaacccggtgatggggtaccaccttgaaccgccagtgcctttggggcgctgcgctgatgactcctacgcctac

SEQ ID NO: 862 - DNA, 62 bp, Burkholderia sp. SRS-W-2-2016
  misc_feature (1)..(62): MSDV01000018.1/183941-183880 Burkholderia sp. SRS-W-2-2016 contig42914, whole genome shotgun sequence
tgcgcggctggagatggcattctccattaaccgcccttggggctgatgatgcctgctacgcc

SEQ ID NO: 863 - DNA, 64 bp, Candidatus Schekmanbacteria bacterium
  misc_feature (1)..(64): MGDB01000157.1/8681-8618 Candidatus Schekmanbacteria bacterium GWA2_38_11 gwa2_scaffold_9836, whole genome shotgun sequence
tttaaaaatggcgatggggttcgcctctaaccatccataaaggattgatgactcctactgaaac

SEQ ID NO: 864 - DNA, 61 bp, Joostella marina DSM 19592
  misc_feature (1)..(61): JH651379.1/2048345-2048285 Joostella marina DSM 19592 genomic scaffold Joomascaffold_1, whole genome shotgun sequence
acatacaaaggcgatggagttcgccaaaaccgcccaaaaagctaatgactcctactcaatt

SEQ ID NO: 865 - DNA, 65 bp, Patulibacter medicamentivorans strain I11
  misc_feature (1)..(65): AGUD01000045.1/10920-10984 Patulibacter medicamentivorans strain I11 contig45, whole genome shotgun sequence
cggccgcagagcgatgaggcccgctccacaaccgcggcgtgaccgctgatggcttctacgaccac

SEQ ID NO: 866 - DNA, 73 bp, Cryobacterium arcticum strain PAMC 27867 chromosome 1
  misc_feature (1)..(73): CP016282.1/3754118-3754190 Cryobacterium arcticum strain PAMC 27867 chromosome 1, complete sequence
cttttgcgtggtgatggatcccaccagagcacccgctcgaaccgccgattgcgctgatggttcctaccgactt

SEQ ID NO: 867 - DNA, 73 bp, Enterococcus dispar ATCC 51266
  misc_feature (1)..(73): KE136354.1/938710-938782 Enterococcus dispar ATCC 51266 genomic scaffold acpMG-supercont1.1, whole genome shotgun sequence
gaatattcagggaatgatgatctcccatggacttatccaaaaccgctattaagctaatgacttctacaagttt

SEQ ID NO: 868 - DNA, 73 bp, Herbaspirillum sp. HZ10
  misc_feature (1)..(73): NJGU01000005.1/267616-267544 Herbaspirillum sp. HZ10 Scaffold3_1, whole genome shotgun sequence
atgcgcgccggagatggcattcctccccgaaccgccgccggcatccgccggggctgatgatgcctacggatac

SEQ ID NO: 869 - DNA, 63 bp, Rhizobiales bacterium 65-79
  misc_feature (1)..(63): MKRJ01000013.1/39700-39638 Rhizobiales bacterium 65-79 SCNpilot_cont_1000_bf_scaffold_187, whole genome shotgun sequence
tcgcccgatagggatggggttcccccgacaaccgccgaaaaggctgatgactcctgccagggc

SEQ ID NO: 870 - DNA, 59 bp, Bacillus galactosidilyticus strain PL133
  misc_feature (1)..(59): LGPB01000103.1/27152-27094 Bacillus galactosidilyticus strain PL133 scaffold000103, whole genome shotgun sequence
tttcgtttaggcaatggagttcaccaaaactgctgaacgctaatgactcctgccgaaaa

SEQ ID NO: 871 - DNA, 63 bp, Propionispora sp. 2/2-37 isolate 2/2-37
  misc_feature (1)..(63): CYSP01000007.1/25074-25012 Propionispora sp. 2/2-37 isolate 2/2-37 genome assembly, contig: 2/2_contig7
tgaatagcgggcgatggagttcgccttgaattccgtataaacggtaatgactcctaccaccta

SEQ ID NO: 872 - DNA, 73 bp, Ornatilinea apprima strain P3M-1
  misc_feature (1)..(73): LGCL01000045.1/11910-11982 Ornatilinea apprima strain P3M-1 contig_4, whole genome shotgun sequence
aattaaaaaagcgatgaggctcgcttgagatgtaatcaaaccgccgtttttggctgatagcctctgtcttatt

SEQ ID NO: 873 - DNA, 83 bp, Chthoniobacter flavus Ellin428 ctg77
  misc_feature (1)..(83): ABVL01000003.1/298778-298860 Chthoniobacter flavus Ellin428 ctg77, whole genome shotgun sequence
gcccgtaacggcaatggatttctgccgcccgagtgatcggggaaccgcttggtaacggccaggctgatgattcctgttttcac

SEQ ID NO: 874 - DNA, 80 bp, Elusimicrobia bacterium
  misc_feature (1)..(80): MGTS01000012.1/84755-84676 Elusimicrobia bacterium GWA2_51_34 gwa2_scaffold_159, whole genome shotgun sequence
taaattaacggcgatgatgtccgcctccctggcctcaccggggaaaccgctcacaatgggctgatgacctctatctaaaa

SEQ ID NO: 875 - DNA, 60 bp, Clostridium argentinense CDC 2741 U732
  misc_feature (1)..(60): AYSO01000017.1/378466-378525 Clostridium argentinense CDC 2741 U732.Contig249, whole genome shotgun sequence
atatcacaagatgatggagttcaccataatcgcagaaatgctaatgactcctacaagatg

SEQ ID NO: 876 - DNA, 62 bp, Xanthomonadaceae bacterium SCN 69-48
  misc_feature (1)..(62): MEFQ01000335.1/3112-3173 Xanthomonadaceae bacterium SCN 69-48 ABS98_C0335, whole genome shotgun sequence
gcccatacgggagatggcatcctccccgaaccgccgtcccggctgatgatgcctgccaaccc

SEQ ID NO: 877 - DNA, 63 bp, Moorella glycerini strain NMP
  misc_feature (1)..(63): CELZ01000050.1/60745-60807 Moorella glycerini strain NMP genome assembly, contig: M_glycerini_NMP_DRAFT_scaffold-50
atagttttaggcgatggagttcgccttaaatctgcagcaagcagtgatgactcctaccaaaaa

SEQ ID NO: 878 - DNA, 62 bp, Thermanaeromonas toyohensis ToBE
  misc_feature (1)..(62): LT838272.1/2866416-2866355 Thermanaeromonas toyohensis ToBE genome assembly, chromosome: I
tataaaagtggcgatggagctcgcctaatgctcaggtttgagctaatggctcctaccgtaat

SEQ ID NO: 879 - DNA, 72 bp, Clostridium hiranonis DSM 13275 Scfld1
  misc_feature (1)..(72): DS995355.1/552971-552900 Clostridium hiranonis DSM 13275 Scfld1 genomic scaffold, whole genome shotgun sequence
atacaactagggaatgaatgtctcccttgggaaacctaaaccgcttatcgagctgatgacttctgcaaccac

SEQ ID NO: 880 - DNA, 85 bp, Chitinophaga pinensis DSM 2588
  misc_feature (1)..(85): CP001699.1/4998418-4998502 Chitinophaga pinensis DSM 2588, complete genome
ccttttacaggaaatggtgtcttcctgcacagaaccgtcttcgccctgatcaatctccggcaagtctgatggcgcctacaaataa

SEQ ID NO: 881 - DNA, 65 bp, Vibrio proteolyticus NBRC 13287
  misc_feature (1)..(65): BATJ01000006.1/80403-80467 Vibrio proteolyticus NBRC 13287 DNA, contig: VPR01S06
cctaagcaaggtgatggggttccacctatttaaccgccgcttgggctgatgactcctacagaaac

SEQ ID NO: 882 - DNA, 64 bp, Sodalis glossinidius str. 'morsitans'
  misc_feature (1)..(64): AP008232.1/1344619-1344556 Sodalis glossinidius str. 'morsitans' DNA, complete genome
ctttccccaggagatgaaattactctttataaccgccgctctggctgatgatgtctacgttcat

SEQ ID NO: 883 - DNA, 82 bp, Humibacillus sp. DSM 29435
  misc_feature (1)..(82): MAST01000004.1/30569-30488 Humibacillus sp. DSM 29435 contig12, whole genome shotgun sequence
gtcggagacggcgatggatcccgccagggtgtgagagcctcacccccaaactgccacctcggctgatggttcctgactcgtc

SEQ ID NO: 884 - DNA, 67 bp, Flavobacterium indicum GPTSA100-9
  misc_feature (1)..(67): HE774682.1/1106424-1106358 Flavobacterium indicum GPTSA100-9 complete genome
gacaaaaaaggaaatggtgttcttccttacccaaccgctttaaaaagctgatgacgcctgattaatt

SEQ ID NO: 885 - DNA, 76 bp, Lysobacter sp. Root96
  misc_feature (1)..(76): LMJN01000001.1/1254218-1254143 Lysobacter sp. Root96 contig_1, whole genome shotgun sequence
atcggtgcaggagatggcattcctcctgtccccaccggggcaaaccgccgccttggctgatgatgcctgctgaccc

SEQ ID NO: 886 - DNA, 105 bp, Natrinema pellirubrum DSM 15624
  misc_feature (1)..(105): CP003372.1/3516099-3516203 Natrinema pellirubrum DSM 15624, complete genome
tcgtatccgggcgatggggcccgcctgacccaactgccgaccgccgttccgaagccgtgacgacccacatcgcggcgacggtcggctgacggtccctgccaccac

SEQ ID NO: 887 - DNA, 68 bp, Commensalibacter intestini A911 74_9
  misc_feature (1)..(68): AGFR01000009.1/332139-332206 Commensalibacter intestini A911 74_9, whole genome shotgun sequence
taaagtttaggagatgatatcctccttgtaaaccgccgcattttgcggatgatgatatctacgcggag

SEQ ID NO: 888 - DNA, 77 bp, Nitrospira sp. OLB3 UZ03_NOB00100CONTIG000070
  misc_feature (1)..(77): JZQY01000069.1/46772-46848 Nitrospira sp. OLB3 UZ03_NOB00100CONTIG000070, whole genome shotgun sequence
gcttcaacaggtgatggagttcaccgagaaccgccggtccacgatgcacatggacggctgataactcctactggcac

SEQ ID NO: 889 - DNA, 71 bp, Providencia burhodogranariea DSM 19968
  misc_feature (1)..(71): KB233222.1/1770946-1770876 Providencia burhodogranariea DSM 19968 genomic scaffold scaffold00001, whole genome shotgun sequence
ttagtttgaggcgatggcattcctcccgtttaagaactgtcctaataaggactgatgatgcctacgttaac

SEQ ID NO: 890 - DNA, 65 bp, Leeuwenhoekiella marinoflava DSM 3653
  misc_feature (1)..(65): FQUN01000003.1/227081-227017 Leeuwenhoekiella marinoflava DSM 3653 genome assembly, contig: EJ63DRAFT_scaffold00001.1
tcaattacaggcaatgaggtctgcctcaaaccgcttcttatgaagctgatgacttctactaaaaa

SEQ ID NO: 891 - DNA, 77 bp, Sphingomonas sp. Leaf42; identical to SEQ ID NO: 771
  misc_feature (1)..(77): LMLF01000003.1/12954-12878 Sphingomonas sp. Leaf42 contig_11, whole genome shotgun sequence

SEQ ID NO: 892 - DNA, 85 bp, Clostridium asparagiforme DSM 15981
  misc_feature (1)..(85): GG657592.1/978902-978818 Clostridium asparagiforme DSM 15981 genomic scaffold Scfld6, whole genome shotgun sequence
cagcgcaaagggaatgaggttctcccgtggcgaaagccagaaccgcttgtaaggcagattatgagctgatgacttctgtgatgat

SEQ ID NO: 893 - DNA, 62 bp, Enterococcus pallens ATCC BAA-351
  misc_feature (1)..(62): KB946300.1/215687-215748 Enterococcus pallens ATCC BAA-351 genomic scaffold acvKb-supercont1.1, whole genome shotgun sequence
tcgtgaataagggatggtgttcccgataactgctaaaattagctgatgacacctgtttaact

SEQ ID NO: 894 - DNA, 66 bp, Burkholderia sp. STM 7183
  misc_feature (1)..(66): CYGY02000045.1/572-637 Burkholderia sp. STM 7183 genome assembly, contig: CYGY01000045
tcgattgacggagatggcattcctcccgtaaccgccggttggccggctaatgatgcctacggttcc

SEQ ID NO: 895 - DNA, 77 bp, Pantoea ananatis LMG 20103
  misc_feature (1)..(77): CP001875.2/4203225-4203149 Pantoea ananatis LMG 20103, complete genome
cgcgcataaggtgatggcgttccacctttcccaaccgcctgcaggcgtaacctgcggctgatgacgcctgacattat

SEQ ID NO: 896 - DNA, 65 bp, Clostridiales bacterium
  misc_feature (1)..(65): LAKY01000069.1/17972-18036 Clostridiales bacterium PH28_bin88 ph28_412, whole genome shotgun sequence
aactatcatggcgatggggttcgccataaacactgcccctggcggttgataacccctaccaaatt

SEQ ID NO: 897 - DNA, 75 bp, Microlunatus phosphovorus NM-1 DNA
  misc_feature (1)..(75): AP012204.1/4277444-4277518 Microlunatus phosphovorus NM-1 DNA, complete genome
gtgaatcgcggcgatggcgtccgccaggggtagctccccgaaccgccccgcagggctgatgactcctgagacgat

SEQ ID NO: 898 - DNA, 72 bp, Gemmatimonadetes bacterium
  misc_feature (1)..(72): MGZG01000181.1/10510-10581 Gemmatimonadetes bacterium RIFCSPLOWO2_12_FULL_68_9 rifcsplowo2_12_scaffold_21457, whole genome shotgun sequence
ctcggcgccggcgatggagttcgccgtcaaccgtcccctgccattcagtggactgatgactcctggaaccct

SEQ ID NO: 899 - DNA, 64 bp, Archaeoglobus veneficus SNP6
  misc_feature (1)..(64): CP002588.1/1355815-1355752 Archaeoglobus veneficus SNP6, complete genome
ctgtatgcgggtgatggcgtccacccttaaccgcccggcaagggctgatgacgcctgttttcgg

SEQ ID NO: 900 - DNA, 65 bp, Haladaptatus sp. R4
  misc_feature (1)..(65): LWHG01000001.1/82066-82130 Haladaptatus sp. R4 NODE_10_length_139766_cov_26.9624_ID_1043, whole genome shotgun sequence
gctatcgcgggagatggggtcctccttcaaccgccacgaaactggctgacgatccctgcgaaggt

SEQ ID NO: 901 - DNA, 61 bp, Bacteroidetes bacterium
  misc_feature (1)..(61): MEOG01000126.1/84306-84366 Bacteroidetes bacterium GWF2_35_48 gwf2_scaffold_871, whole genome shotgun sequence
ttccattctggtgatggagttcgccataaactgcaattgtgctgataactcctgcaatttt

SEQ ID NO: 902 - DNA, 79 bp, Candidatus Fraserbacteria bacterium
  misc_feature (1)..(79): MFGX01000109.1/13660-13738 Candidatus Fraserbacteria bacterium RBG_16_55_9 RBG_16_scaffold_6090, whole genome shotgun sequence
ttatcgctgggcgatggagtccgccggggagcgcctgctcccaaaccgtcccaactggactgatggctcctacctgaac

SEQ ID NO: 903 - DNA, 70 bp, Chryseobacterium bovis DSM 19482
  misc_feature (1)..(70): FTPU01000060.1/8776-8845 Chryseobacterium bovis DSM 19482 genome assembly, contig: LX71DRAFT_scaffold00060.60
attcgcaaaggaaatggtgttcttccttacccaaccgctttttcaaaaagctgatgacgcctgattaatg

SEQ ID NO: 904 - DNA, 60 bp, Bacillus shackletonii strain LMG 18435 super11
  misc_feature (1)..(60): LJJC01000004.1/3650072-3650013 Bacillus shackletonii strain LMG 18435 super11, whole genome shotgun sequence
aactcaataggcgatggggttcgccaaaaacgctgaaaagctaatgactcctaccagtat

SEQ ID NO: 905 - DNA, 67 bp, Moheibacter sediminis strain CGMCC 1.12708
  misc_feature (1)..(67): FWXS01000009.1/123184-123250 Moheibacter sediminis strain CGMCC 1.12708 genome assembly, contig: Ga0171597_109
aaaataaaaggaaatggtgttcttccttacccaaaccgcgtaaatcgctgatgacgcctgattttta

SEQ ID NO: 906 - DNA, 66 bp, Kozakia baliensis strain DSM 14400
  misc_feature (1)..(66): CP014675.1/5635-5570 Kozakia baliensis strain DSM 14400 plasmid pKB14400_1, complete sequence
tcccgaccaggggatggagctcccccttcaaccgccctcgcaagggctgatggctcctaccgcgac

SEQ ID NO: 907 - DNA, 63 bp, Paenibacillus sp. TI45-13ar
  misc_feature (1)..(63): MDER01000075.1/31306-31368 Paenibacillus sp. TI45-13ar contig00075, whole genome shotgun sequence
aataaaatcggcgatggagttcgccattgactgctgatttcagctaatgactcctacttgttt

SEQ ID NO: 908 - DNA, 72 bp, Paraburkholderia tropica strain P-31
  misc_feature (1)..(72): LXGI01000116.1/48114-48185 Paraburkholderia tropica strain P-31 P31_contig_7, whole genome shotgun sequence
ggcactttcggagatggcattcctcccgtaaccgcaccgcttcccggcggcgctgatgatgcctacgagttc

SEQ ID NO: 909 - DNA, 74 bp, Deltaproteobacteria bacterium
  misc_feature (1)..(74): MGQI01000010.1/2334-2261 Deltaproteobacteria bacterium RBG_13_58_19 RBG_13_scaffold_11141, whole genome shotgun sequence
aatcaaacaggcgatgaagtccgccgtaaccgccctgccagctatgacgcggggctgatgacttctgtccattt

SEQ ID NO: 910 - DNA, 63 bp, Pseudaminobacter manganicus strain JH-7
  misc_feature (1)..(63): MDET01000028.1/31339-31401 Pseudaminobacter manganicus strain JH-7 JH-7_scaffold34, whole genome shotgun sequence
ggcttcgatgggaatggagttctcccgaaagcgcctgtgagagctgatgactcctatcgcgga

SEQ ID NO: 911 - DNA, 62 bp, Cloacibacillus evryensis DSM 19522; identical to SEQ ID NO: 478
  misc_feature (1)..(62): KK073872.1/385211-385150 Cloacibacillus evryensis DSM 19522 genomic scaffold CloevDRAFT_Scaffold1.1, whole genome shotgun sequence

SEQ ID NO: 912 - DNA, 62 bp, Bacterium UASB14
  misc_feature (1)..(62): DF820460.1/629916-629977 Bacterium UASB14 DNA, scaffold: UASB14_scaffold_6
acaaaataaggtgatggggttcacctctaaccgcacgcatcgctgataactcctacaaacta

SEQ ID NO: 913 - DNA, 62 bp, Acidithiobacillus caldus SM-1
  misc_feature (1)..(62): CP002573.1/2024788-2024849 Acidithiobacillus caldus SM-1, complete genome
ctttccaacggcgatgaggtccgcctggaaccgccttcgtggctaatgacttctaccgaatc

SEQ ID NO: 914 - DNA, 73 bp, Enterococcus sp. RIT-PI-f
  misc_feature (1)..(73): LHOX01000018.1/204801-204729 Enterococcus sp. RIT-PI-f contig_1, whole genome shotgun sequence
agcgaaaaaggaaatgaatgtcttcctcagtcttaactgaaaccgcaaacttgctaatgacttctaccactta

SEQ ID NO: 915 - DNA, 67 bp, Frateuria sp. Soil773
  misc_feature (1)..(67): LMSL01000040.1/117726-117792 Frateuria sp. Soil773 contig_8, whole genome shotgun sequence
ttggaaacgggagatggcattcctcccccgacccaaccgccgcaaggctgatgatgcctacccgtcg

SEQ ID NO: 916 - DNA, 76 bp, Roseburia sp. 499
  misc_feature (1)..(76): MJID01000007.1/419613-419688 Roseburia sp. 499 contig000007, whole genome shotgun sequence
atcattgttgggaatgaggttctcccttagtgataacactaaaaccgcttattaagctgatgacttctgcgaatta

SEQ ID NO: 917 - DNA, 70 bp, Sphingobacterium faecium PCAi_F2.5
  misc_feature (1)..(70): FUKX01000034.1/78618-78549 Sphingobacterium faecium PCAi_F2.5 genome assembly, contig: Scaffold8
tagcaacatggtgatggtgttcaccacgaactatttattggacgaataaattaatgacgcctaccaaacg

SEQ ID NO: 918 - DNA, 75 bp, Vibrio harveyi ATCC BAA-1116 chromosome I
  misc_feature (1)..(75): CP000789.1/3337036-3337110 Vibrio harveyi ATCC BAA-1116 chromosome I, complete sequence
aatgggcacggtgatggggtgccaccggaatcgaaagattcgaaccgctttaaagctaatgactcctacagaaac

SEQ ID NO: 919 - DNA, 67 bp, Paraburkholderia susongensis strain LMG 29540
  misc_feature (1)..(67): FXAT01000003.1/190021-190087 Paraburkholderia susongensis strain LMG 29540 genome assembly, contig: Ga0139082_103
gaattcagtggagatggcattcctcccgaaccgccggtcaagtccggctgatgatgcctacgagttc

SEQ ID NO: 920 - DNA, 60 bp, Kosmotoga olearia TBF 19.5.1
  misc_feature (1)..(60): CP001634.1/455111-455170 Kosmotoga olearia TBF 19.5.1, complete genome
atttctttgggcgatggggtccgccctaattgccaaaaggctgatgactcctatctctat

SEQ ID NO: 921 - DNA, 74 bp, Desulfobacca acetoxidans DSM 11109
  misc_feature (1)..(74): CP002629.1/3040640-3040713 Desulfobacca acetoxidans DSM 11109, complete genome
gtgcaaataggtgatgaggtccaccataactgccttgccgaggaattggccgggatgatgacttctgccccaca

SEQ ID NO: 922 - DNA, 69 bp, Acetobacter orientalis 21F-2
  misc_feature (1)..(69): BAMX01000001.1/9377-9445 Acetobacter orientalis 21F-2 DNA, contig: Abor_001
aaccttacaggggatggagtacccccttataaccgcccgcttgtaagggctgatgactcctgccgtagt

SEQ ID NO: 923 - DNA, 63 bp, Spinacia oleracea cultivar SynViroflay
  misc_feature (1)..(63): AYZV02266241.1/1351-1289 Spinacia oleracea cultivar SynViroflay scaffold87624.con0007.1, whole genome shotgun sequence
tgggacaatggcgatggagtaccgccaaaaccgcccaaacaggctgatgactcctatgatttt

SEQ ID NO: 924 - DNA, 61 bp, Alphaproteobacteria bacterium
  misc_feature (1)..(61): MNDV01000274.1/341-401 Alphaproteobacteria bacterium 13_2_20CM_2_64_7 13_2_20cm_2_scaffold_5513, whole genome shotgun sequence
gaaacgaacggggatggggtcccccacaaccgccgcgcaggctgatgactcctaccggtta

SEQ ID NO: 925 - DNA, 61 bp, Paenibacillus yonginensis strain DCY84 chromosome
  misc_feature (1)..(61): CP014167.1/3902176-3902116 Paenibacillus yonginensis strain DCY84 chromosome, complete genome
aacacgataggcgatggagttcgccataaccgccctttgggctgatgactcctaccagttt

SEQ ID NO: 926 - DNA, 59 bp, Clostridium acidisoli DSM 12555
  misc_feature (1)..(59): FWXH01000002.1/821201-821143 Clostridium acidisoli DSM 12555 genome assembly, contig: EJ29DRAFT_scaffold00001.1
ttttttataggtgatggagttcaccttaaatgcttagagctgatgactcctataggttt

SEQ ID NO: 927 - DNA, 124 bp, Elusimicrobia bacterium
  misc_feature (1)..(124): MGUI01000007.1/127981-127858 Elusimicrobia bacterium GWD2_63_28 gwd2_scaffold_122, whole genome shotgun sequence
attaataacggcgatgatgtccgccgccccggccgcccggggaaaccgcccgcgaggccgtctgaggcgcatagcgcttgttacggcacggccataggccagggctgatgacctctacccccta

SEQ ID NO: 928 - DNA, 77 bp, Bradyrhizobium sp. Leaf396
  misc_feature (1)..(77): LMQJ01000004.1/88217-88293 Bradyrhizobium sp. Leaf396 contig_12, whole genome shotgun sequence
cacacagatggggatggagtcccccgacaaccgcccggcggtcgatgacctcgtgggctgatgactcctgcttgagg

SEQ ID NO: 929 - DNA, 69 bp, Deltaproteobacteria bacterium
  misc_feature (1)..(69): MGSY01000755.1/450-382 Deltaproteobacteria bacterium RIFOXYB2_FULL_66_7 rifoxyb2_full_scaffold_71842_curated, whole genome shotgun sequence
cgtgaacccggcgatggagttcgccgtgaaccgcctatgtcgatagaggctgatgactcctaccctaca

SEQ ID NO: 930 - DNA, 69 bp, Acidobacteria bacterium SCN 69-37
  misc_feature (1)..(69): MEDJ01000005.1/88809-88741 Acidobacteria bacterium SCN 69-37 ABS36_C0005, whole genome shotgun sequence
gtgtcgtctggcggtggagtccgcctgaaccgccgttccgaccggacggccaatgactcctgcgggccc

SEQ ID NO: 931 - DNA, 74 bp, Armatimonadetes bacterium
  misc_feature (1)..(74): MNXM01000330.1/10724-10651 Armatimonadetes bacterium CG2_30_59_28 cg2_3.0_scaffold_2174_c, whole genome shotgun sequence
ggcgtcaatggcgatggagttcgcccgtccgaacagacaaacggcctctgatgactgatgactcctgatcccga

SEQ ID NO: 932 - DNA, 63 bp, Aneurinibacillus migulanus strain DSM 2895 super7
  misc_feature (1)..(63): LGUG01000004.1/3070818-3070756 Aneurinibacillus migulanus strain DSM 2895 super7, whole genome shotgun sequence
agttgtataggcgatggagttcgccgtaaccgctgactgacagctaatgactcctaccggacg

SEQ ID NO: 933 - DNA, 76 bp, Thermococcus paralvinellae strain ES1 chromosome
  misc_feature (1)..(76): CP006965.1/512354-512279 Thermococcus paralvinellae strain ES1 chromosome, complete genome
gttaactcgggcgatggcgtccgcccgggcttcgagcccgaaccgcccgcaaagggctgatgacgcctgttctaac

SEQ ID NO: 934 - DNA, 68 bp, Vibrio fischeri ES114 chromosome I
  misc_feature (1)..(68): CP000020.2/35443-35510 Vibrio fischeri ES114 chromosome I, complete sequence
ccaaatacgggtgatggatttccacctttaaccgctctatttttagagataatgattcctactatagc

SEQ ID NO: 935 - DNA, 77 bp, Rhizobium yanglingense strain CCBAU 01603
  misc_feature (1)..(77): KZ248224.1/8923-8847 Rhizobium yanglingense strain CCBAU 01603 genomic scaffold C573, whole genome shotgun sequence
acgcgcaacggtaatggattctgccgggcattacgccaaaccgcttccccgacgaagctgatgactcctactcaacg

SEQ ID NO: 936 - DNA, 62 bp, Planctomycetes bacterium
  misc_feature (1)..(62): MHXP01000105.1/6885-6824 Planctomycetes bacterium GWA2_39_15 gwa2_scaffold_29798, whole genome shotgun sequence
tgataataaggcgatggagttcgcccaactgctacgttgtagctgataactcctattgaagc

SEQ ID NO: 937 - DNA, 68 bp, Hydrogenophilaceae bacterium
  misc_feature (1)..(68): MNXE01000063.1/20102-20035 Hydrogenophilaceae bacterium CG1_02_62_390 cg_0.2_sub10_scaffold_23_c, whole genome shotgun sequence
ttcaaagcaggagatggcatacctcctaataaccgcctgggttcccggctgatgatgcctacgcgaac

SEQ ID NO: 938 - DNA, 63 bp, 194354 Pelosinus fermentans B4 ctg2
  misc_feature (1)..(63): AKVJ01000022.1/194416-194354 Pelosinus fermentans B4 ctg2, whole genome shotgun sequence
gttactgggggcgatggggttcgccattaaatctgctgatgcagtaatgactcctaccaacat

SEQ ID NO: 939 - DNA, 65 bp, Candidatus Glassbacteria bacterium
  misc_feature (1)..(65): MFIX01000182.1/183-247 Candidatus Glassbacteria bacterium RIFCSPLOWO2_12_FULL_58_11 rifcsplowo2_12_scaffold_44438, whole genome shotgun sequence
caataaacaggggatggagtcccccttcaagcgctctttccagggctgatggctcctaccgcggg

SEQ ID NO: 940 - DNA, 60 bp, Clostridium kluyveri DSM 555
  misc_feature (1)..(60): CP000673.1/304406-304465 Clostridium kluyveri DSM 555, complete genome
aaataataaggtgatggagttcaccataaccgcagaaatgcttatgactcctacaaataa

SEQ ID NO: 941 - DNA, 74 bp, Anaerococcus prevotii ACS-065-V-Col13
  misc_feature (1)..(74): AEXM01000013.1/22000-21927 Anaerococcus prevotii ACS-065-V-Col13 contig00044, whole genome shotgun sequence
atatatttaggaaatgaagttcttcccaaaatttatattttaaaccgctataagctaatgacttctgcacttgc

SEQ ID NO: 942 - DNA, 76 bp, Xanthomonas fragariae strain PD5205
  misc_feature (1)..(76): LT853885.1/2227198-2227273 Xanthomonas fragariae strain PD5205 genome assembly, chromosome: 1
tagatgctcggagatggcgttcctccgcgctgttccatcaaccgtagcgatcgctactgatgacgcctacaaaaac

SEQ ID NO: 943 - DNA, 62 bp, Sphingomonas sp. 67-41
  misc_feature (1)..(62): MKWJ01000020.1/48107-48046 Sphingomonas sp. 67-41 SCNpilot_cont_300_bf_scaffold_301, whole genome shotgun sequence
atagggttcggggatggagttccccatcaaccgccgcaaaggctgataactcctaccagaac

SEQ ID NO: 944 - DNA, 61 bp, Pseudobacteroides cellulosolvens ATCC 35603 = DSM 2933 ctg1; identical to SEQ ID NO: 844
  misc_feature (1)..(61): LGTC01000001.1/3350936-3350876 Pseudobacteroides cellulosolvens ATCC 35603 = DSM 2933 ctg1, whole genome shotgun sequence

SEQ ID NO: 945 - DNA, 78 bp, Bradyrhizobium sp. NAS80.1
  misc_feature (1)..(78): LGHL01000085.1/63834-63757 Bradyrhizobium sp. NAS80.1 Bradyrhizobium_NAS_80.1_c85, whole genome shotgun sequence
cgcacagatggggatggagtcccccgacaaccgcccggtggtcgatgaccgtagtgggctgatgactcctgcttgagg

SEQ ID NO: 946 - DNA, 79 bp, Elusimicrobia bacterium
  misc_feature (1)..(79): MGVC01000049.1/51974-51896 Elusimicrobia bacterium RIFOXYA2_FULL_39_19 rifoxya2_full_scaffold_350, whole genome shotgun sequence
tgtttcactggtgatggatctccacctaaccattctctcaggttaaaccgccctaaaagctgatggttcctactaaaaa

SEQ ID NO: 947 - DNA, 85 bp, Rhodoplanes sp. Z2-YC6860
  misc_feature (1)..(85): CP007440.1/1559223-1559139 Rhodoplanes sp. Z2-YC6860, complete genome
tgcgccgatgggaatggggttctcccgataaccgcccggcgaacagacaatccaggttcgttgcgctgatgactcctaccgctga

SEQ ID NO: 948 - DNA, 67 bp, Halarchaeum acidiphilum MH1-52-1
  misc_feature (1)..(67): BATA01000004.1/44861-44927 Halarchaeum acidiphilum MH1-52-1 DNA, contig: HAL004
cacggtagcggcgatggagtccgccctttaactgccggggacgccggctgatgactcctgtggagaa

SEQ ID NO: 949 - DNA, 62 bp, Elusimicrobia bacterium
  misc_feature (1)..(62): MGVP01000586.1/3611-3672 Elusimicrobia bacterium RIFOXYB2_FULL_62_6 rifoxyb2_full_scaffold_5602, whole genome shotgun sequence
atttagcaaggcgatggagttcgccttaaccgcccgaaagggctgatgactcctgcgatacg

SEQ ID NO: 950 - DNA, 70 bp, Bifidobacterium breve DSM 20213
  misc_feature (1)..(70): GG729830.1/772508-772439 Bifidobacterium breve DSM 20213 genomic scaffold Scfld0, whole genome shotgun sequence
ctgggattcggcgatgggacccgcctgaacttgtttcgaaccgcacactgctgatagttcctacacacga

SEQ ID NO: 951 - DNA, 75 bp, Thermococcus onnurineus NA1
  misc_feature (1)..(75): CP000855.1/737518-737592 Thermococcus onnurineus NA1, complete genome
ggcttttcgggcgatggcgtccgcccgggcttcgagccgaaccgcccgttttgggctgatgacgcctgttctctg

SEQ ID NO: 952 - DNA, 112 bp, Geitlerinema sp. PCC 7407
  misc_feature (1)..(112): CP003591.1/2313962-2314073 Geitlerinema sp. PCC 7407, complete genome
tagaatctaggcgatggagctcgccataaccgccgtccggcgatcgcgctaaaatttgcgccgaccttttttctaaactggctttggactggctgatggctcctacttgttt

SEQ ID NO: 953 - DNA, 101 bp, Rhodococcus rhodnii LMG 5362
  misc_feature (1)..(101): APMY01000064.1/29715-29815 Rhodococcus rhodnii LMG 5362 LMG_5362_contig070, whole genome shotgun sequence
cttggctccggcgatggatcccgccagggttcgattgtcggccgcgtcggcggccggcgcggcccgaaccgccgacaccggctgatggttcctttccgatc

SEQ ID NO: 954 - DNA, 74 bp, Rhizobium sp. LC145 LC145
  misc_feature (1)..(74): LBHV01000005.1/188693-188766 Rhizobium sp. LC145 LC145_contig5, whole genome shotgun sequence
tcgctccacggcgatggatttctgccgggccacacggccaaaccgcccagagggcggatgattcctactcggtt

SEQ ID NO: 955 - DNA, 69 bp, Pedobacter sp. AJM
  misc_feature (1)..(69): NHOT01000002.1/395628-395696 Pedobacter sp. AJM contig02, whole genome shotgun sequence
ttgcaatacggaaatggtgtccttccgattcaaccgcttttttcaaaagctgatggcgcctacaataga

SEQ ID NO: 956 - DNA, 63 bp, Ochrobactrum sp. P6BS-III
  misc_feature (1)..(63): MPPJ01000001.1/323127-323065 Ochrobactrum sp. P6BS-III NODE_1_length_445701_cov_32.571, whole genome shotgun sequence
atgcatgatgggaatggggttctcccgaaaccgccgcttctggctgatgactcctgatcgaat

SEQ ID NO: 957 - DNA, 78 bp, Bradyrhizobium sp. LTSP849
  misc_feature (1)..(78): JYMR01000028.1/78932-79009 Bradyrhizobium sp. LTSP849 NODE_28, whole genome shotgun sequence
cgcacagatggggatggagtcccccgacaaccgcccgacggtcgatgatcgtgctgggctgatgactcctgcttgagg

SEQ ID NO: 958 - DNA, 95 bp, Novosphingobium sp. SCN 63-17
  misc_feature (1)..(95): MEGC01000066.1/1080-1174 Novosphingobium sp. SCN 63-17 ABT10_C0066, whole genome shotgun sequence
cgcgtccaaggcgatggatttccgccgggcctttgggccgaaccgcccggccctagggcaacttggggtcacaggctgatgattcctacctttcg

SEQ ID NO: 959 - DNA, 98 bp, Clostridiales bacterium CHKCI001 isolate CHKC1
  misc_feature (1)..(98): FCNS01000019.1/7032-7129 Clostridiales bacterium CHKCI001 isolate CHKC1 genome assembly, contig: {contig19}
atgatgcaagggaatgaagttctcccttagtgaatgatattggaacataaaataaccaaacactagaaccgcttaatgctgatgacttctgctataaa

SEQ ID NO: 960 - DNA, 63 bp, Flavobacterium sp. 40-81
  misc_feature (1)..(63): MKTM01000033.1/104869-104931 Flavobacterium sp. 40-81 scnpilot_p_inoc_scaffold_71, whole genome shotgun sequence
tacaaatacggcaatgatgtctgccttgaaccgccttaaaaagctgatgacgtctattgaatg

SEQ ID NO: 961 - DNA, 78 bp, Eubacterium ruminantium strain ATCC 17233
  misc_feature (1)..(78): FUXA01000010.1/84794-84717 Eubacterium ruminantium strain ATCC 17233 genome assembly, contig: EI46DRAFT_scaffold00008.8
attggtattgggaatgaggtctcccaaagcagcatgcctgcttaaaccgcttattaggctgatgacttctgcatcttt

SEQ ID NO: 962 - DNA, 61 bp, Pseudothermotoga thermarum DSM 5069 chromosome
  misc_feature (1)..(61): CP002351.1/495496-495436 Pseudothermotoga thermarum DSM 5069 chromosome, complete genome
attaatttgggcgatggagtccgcctttaatagccatgaggctgatgactcctacaggttg

SEQ ID NO: 963 - DNA, 62 bp, Paenibacillus sp. P1XP2
  misc_feature (1)..(62): JRNV01000011.1/18234-18295 Paenibacillus sp. P1XP2 CM49_contig000011, whole genome shotgun sequence
cgaataaaaggcgatggagttcgccataaccgcctgaaaaggctgatgactcctaccggtga

SEQ ID NO: 964 - DNA, 89 bp, Phormidium ambiguum IAM M-71
  misc_feature (1)..(89): MRCE01000059.1/24343-24431 Phormidium ambiguum IAM M-71 NIES-2119_Scaffold_59, whole genome shotgun sequence
aataaagatggcgatggagctcgccaaaaccgcctttgattattgaattaattcataaaatctaaaaggctgatggctcctactattcc

SEQ ID NO: 965 - DNA, 62 bp, Nitrospinae bacterium RIFCSPLOWO2_02_39_17
  misc_feature (1)..(62): MHDL01000053.1/7947-8008 Nitrospinae bacterium RIFCSPLOWO2_02_39_17 rifcsplowo2_02_sub10_scaffold_2327, whole genome shotgun sequence
aaataaacaggtgatggagttcacctttaaccgactgaattgctgataactccttacattac

SEQ ID NO: 966 - DNA, 72 bp, Firmicutes bacterium CAG:345
  misc_feature (1)..(72): FR893375.1/102776-102705 Firmicutes bacterium CAG:345 genomic scaffold, scf22
aatatctatggaaatgatgtcttccatctagtgatagagaactgcaatattgctgatgacgtctatagtttt

SEQ ID NO: 967 - DNA, 64 bp, Chania multitudinisentens RB-25
  misc_feature (1)..(64): CP007044.2/4758383-4758446 Chania multitudinisentens RB-25, complete genome
acgaccaacggagatgacattcctccattaaccgccctttcaggctgatgatgtctacgtaacc

SEQ ID NO: 968 - DNA, 61 bp, Burkholderia sp. STM 7296 strain STM7296
  misc_feature (1)..(61): CYGX02000040.1/25150-25210 Burkholderia sp. STM 7296 strain STM7296 genome assembly, contig: BN2475_Contig_040
tgcggcgctggagatggcattctccattaaccgcctcgaagctgatgatgcctgcttcgcc

SEQ ID NO: 969 - DNA, 66 bp, Acinetobacter nectaris CIP 110549
  misc_feature (1)..(66): KI530723.1/120678-120613 Acinetobacter nectaris CIP 110549 genomic scaffold adgTG-supercont2.2, whole genome shotgun sequence
tgagatataggaaatggcatcttccttttaaaaaccgccaatatggctaatgatgcctacgtaacc

SEQ ID NO: 970 - DNA, 65 bp, Acidocella aminolytica 101 = DSM 11237
  misc_feature (1)..(65): BANC01000005.1/58240-58304 Acidocella aminolytica 101 = DSM 11237 DNA, contig: Aam_005
caggcagacggggatggagtcccccaaaaccgctccttcggggagctgatgactcctgcaggcgt

SEQ ID NO: 971 - DNA, 65 bp, Clostridium tyrobutyricum DIVETGP, WGS project CBXI01000000 data
  misc_feature (1)..(65): CBXI010000023.1/134848-134912 Clostridium tyrobutyricum DIVETGP, WGS project CBXI01000000 data, contig: NODE_74
tgtatcttaggtgatgaagttcacctttaaccatctcttccgggattgatgacttctactataca

SEQ ID NO: 972 - DNA, 61 bp, Peptoclostridium acidaminophilum DSM 3953 plasmid EAL2_808p
  misc_feature (1)..(61): CP007453.1/365503-365563 Peptoclostridium acidaminophilum DSM 3953 plasmid EAL2_808p, complete sequence
atgagaataggtgatggggttcgcctttaaacgcatttatgctgatgactcctgcaatgaa

SEQ ID NO: 973 - DNA, 81 bp, Mycobacterium kansasii 732
  misc_feature (1)..(81): JANZ01000004.1/80066-80146 Mycobacterium kansasii 732 gmk732.contig.3, whole genome shotgun sequence
gggtgtcgcggcgatggatgtccgccgggatcatgttgactatccgaaccgcccacacgggatgatgactcctaccgaatg

SEQ ID NO: 974 - DNA, 61 bp, Mycobacterium xenopi 3993; identical to SEQ ID NO: 222
  misc_feature (1)..(61): JAOC01000010.1/312580-312520 Mycobacterium xenopi 3993 GMX3993.contig.9, whole genome shotgun sequence

SEQ ID NO: 975 - DNA, 74 bp, Clostridium sp. W14A NODE_46
  misc_feature (1)..(74): MBSV01000068.1/14114-14041 Clostridium sp. W14A NODE_46, whole genome shotgun sequence
tgtcattaaagggatgaagctcccctttggaaatatccgaatcgctggcaacggctgatggcttctacaggagt

SEQ ID NO: 976 - DNA, 78 bp, Elusimicrobia bacterium RIFCSPLOWO2_02_FULL_61_11
  misc_feature (1)..(78): MGUV01000020.1/11423-11346 Elusimicrobia bacterium RIFCSPLOWO2_02_FULL_61_11 rifcsplowo2_02_scaffold_16467, whole genome shotgun sequence
aattagagcggcgatgatgtccgccgccccggaaagccgggggaaccgtccgcgtggactgatgacctctaccctgat

SEQ ID NO: 977 - DNA, 63 bp, Sphingomonas sp. 67-36
  misc_feature (1)..(63): MKSU01000008.1/3888-3950 Sphingomonas sp. 67-36 SCNpilot_cont_300_bf_scaffold_208, whole genome shotgun sequence
gccggcgatggggatggagtacccccgataaccgccgtaccggctgatgactcctgtcatgcg

SEQ ID NO: 978 - DNA, 79 bp, Methanocella paludicola SANAE
  misc_feature (1)..(79): AP011532.1/2430327-2430249 Methanocella paludicola SANAE DNA, complete genome
tgctattctggtgatgaagctcaccgtgctcttatgcagaaccgccgcgcagcgggcgactaatggcttctgatagttc

SEQ ID NO: 979 - DNA, 62 bp, Rhizobiales bacterium 65-79
  misc_feature (1)..(62): MKRJ01000017.1/31079-31140 Rhizobiales bacterium 65-79 SCNpilot_cont_1000_bf_scaffold_222, whole genome shotgun sequence
gtcgtccccggggatggagtccccctccaaccgcctcgccggctgatgactcctgtcgcaac

SEQ ID NO: 980 - DNA, 70 bp, Solirubrobacterales bacterium
  misc_feature (1)..(70): MKST01000003.1/260765-260834 Solirubrobacterales bacterium 67-14 SCNpilot_bf_inoc_scaffold_165, whole genome shotgun sequence
atagccccgagcgatggggctcgctccttcataaccgcggtttcaatccgctgatggctcctgtcaaccg

SEQ ID NO: 981 - DNA, 74 bp, Roseburia intestinalis
  misc_feature (1)..(74): FP929050.1/1488806-1488733 Roseburia intestinalis XB6B4 draft genome
gtatgaaacgggaatgaggttctcccacgattaattcgaaaccgctaaatttagctgatgacttctgtgtagac

SEQ ID NO: 982 - DNA, 62 bp, Methylocystis bryophila strain S285
  misc_feature (1)..(62): CP019948.1/4130853-4130792 Methylocystis bryophila strain S285, complete genome
ccgcgtccaggggatggggtgccccctaaaccgccgcaaaggctgatgactcctgcttgttc

SEQ ID NO: 983 - DNA, 79 bp, Methylobacterium extorquens AM1
  misc_feature (1)..(79): CP001510.1/1276466-1276388 Methylobacterium extorquens AM1, complete genome
gccttcgacggtaatggtgtctgccgggctttgagccgaaccgccgatccttgatgcggctgatgactcctacgattcg

SEQ ID NO: 984 - DNA, 65 bp, Bacteroidetes bacterium 46-16
  misc_feature (1)..(65): MKUN01000004.1/3411-3347 Bacteroidetes bacterium 46-16 SCNpilot_cont_1000_p_scaffold_1313, whole genome shotgun sequence
gcggtaaaagggaatggagtttcccttgcccaaccgccttaatggctgatgactcctgttcaatc

SEQ ID NO: 985 - DNA, 62 bp, Candidatus Jettenia caeni
  misc_feature (1)..(62): BAFH01000003.1/99123-99062 Candidatus Jettenia caeni DNA, contig: KSU1_C
gaattctaaggcgatggagttcgccaaactgctacacggtagctgataactcctattgaggt

SEQ ID NO: 986 - DNA, 61 bp, Thermoanaerobacter tengcongensis MB4
  misc_feature (1)..(61): AE008691.1/1847557-1847497 Thermoanaerobacter tengcongensis MB4, complete genome
aatatttaaggtgatgaagcccaccttaattgccgtaaaggctgatggcttctacgaagat

SEQ ID NO: 987 - DNA, 63 bp, Desulfurella amilsii strain TR1
  misc_feature (1)..(63): MDSU01000018.1/304632-304694 Desulfurella amilsii strain TR1 opera_scaffold_1, whole genome shotgun sequence
gtaaagaaaggcgatggagttcgccttaaaatgcccaccttggctgatgactcctgcataaaa

SEQ ID NO: 988 - DNA, 62 bp, Desulfovibrio mexicanus strain DSM 13116
  misc_feature (1)..(62): FZOC01000002.1/459747-459808 Desulfovibrio mexicanus strain DSM 13116 genome assembly, contig: Ga0070557_102
cagggcgcaggggatggagtcccccttgaaccgcgaatgccgctgatgactcctgctgtacg

SEQ ID NO: 989 - DNA, 73 bp, Clostridiales bacterium
  misc_feature (1)..(73): MGOY01000004.1/4788-4860 Clostridiales bacterium GWF2_38_85 gwf2_scaffold_1205, whole genome shotgun sequence
taagtataagggaatgaagttctctcttacacattgtaaaaccgcttattaagctgatgacttctgcaacacc

SEQ ID NO: 990 - DNA, 66 bp, Candidatus Rokubacteria bacterium; identical to SEQ ID NO: 728
  misc_feature (1)..(66): MNFC01000140.1/3171-3106 Candidatus Rokubacteria bacterium 13_1_40CM_4_69_5 13_1_40cm_4_scaffold_1285, whole genome shotgun sequence

SEQ ID NO: 991 - DNA, 59 bp, Fusobacterium mortiferum ATCC 9817
  misc_feature (1)..(59): GL987988.1/64193-64251 Fusobacterium mortiferum ATCC 9817 genomic scaffold supercont2.2, whole genome shotgun sequence
taaataataggcgatggagttcgcctttaagtgcgaaagctaatgactcctactcttta

SEQ ID NO: 992 - DNA, 59 bp, Peptococcaceae bacterium CEB3
  misc_feature (1)..(59): LDXJ01000062.1/3052-3110 Peptococcaceae bacterium CEB3 CEB3_contig000062, whole genome shotgun sequence
aaaaacccaggcgatggggctcgcttatttgcctgaaggctgatggctcctaccttcaa

SEQ ID NO: 993 - DNA, 73 bp, Erwinia mallotivora strain BT-MARDI
  misc_feature (1)..(73): JFHN01000018.1/140995-140923 Erwinia mallotivora strain BT-MARDI contig_18, whole genome shotgun sequence
gttgcgcaaggtgatggtgttccacctttcccaaccgccccgcctggccggggctgatgacgcctgatatcgc

SEQ ID NO: 994 - DNA, 63 bp, Deltaproteobacteria bacterium RIFCSPLOWO2_12_FULL_57_22
  misc_feature (1)..(63): MGSQ01000223.1/5820-5882 Deltaproteobacteria bacterium RIFCSPLOWO2_12_FULL_57_22 rifcsplowo2_12_scaffold_44076, whole genome shotgun sequence
ccaattcgcggagatggcgttctcccttaaccgcctaccagggctgatgacgcctgcttcatg

SEQ ID NO: 995 - DNA, 67 bp, Dyadobacter psychrophilus strain DSM 22270
  misc_feature (1)..(67): FUZA01000014.1/23719-23785 Dyadobacter psychrophilus strain DSM 22270 genome assembly, contig: LX75DRAFT_scaffold00014.14
acaattacaggaaatggtgtcttcctgcggaaaccgccttaacacggctgatggcgcctattaggat

SEQ ID NO: 996 - DNA, 91 bp, Lachnospiraceae bacterium 9_1_43BFAA
  misc_feature (1)..(91): GL890571.1/895054-895144 Lachnospiraceae bacterium 9_1_43BFAA genomic scaffold supercont1.1, whole genome shotgun sequence
ctttagcaagggaatgaagttctcccttagtaatactaaaaccgccaggtggagcgtgcctcccctgattgctgatgacttctgctttttg

SEQ ID NO: 997 - DNA, 97 bp, Halotalea alkalilenta strain IHB B 13600
  misc_feature (1)..(97): CP015243.1/731191-731095 Halotalea alkalilenta strain IHB B 13600, complete genome
ctgggaactggagatggcatgcctccagccttcggccattcacccagcgaatcacgaagcgaaccgccctcaccgggccgatgatgcctacgcactg

SEQ ID NO: 998 - DNA, 81 bp, Facklamia hominis CCUG 36813
  misc_feature (1)..(81): JH932292.1/1116847-1116767 Facklamia hominis CCUG 36813 genomic scaffold supercont1.1, whole genome shotgun sequence
ctttattgaggaaatgaagtgcttcctggcttacaaagtgtgagtcgaaccgttctaagaactaatgacttctacaagctt

SEQ ID NO: 999 - DNA, 61 bp, Thermosediminibacter oceani DSM 16646
  misc_feature (1)..(61): CP002131.1/442379-442319 Thermosediminibacter oceani DSM 16646, complete genome
aatcaaataggcgatggagttcgccctaaccgtccgtgcgactaatgactcctaccagcga

SEQ ID NO: 1000 - DNA, 68 bp, Chryseobacterium sp. T16E-39 chromosome
  misc_feature (1)..(68): CP022282.1/4852083-4852016 Chryseobacterium sp. T16E-39 chromosome, complete genome
aactgaaaaggaaatggtgttcttccttacccaaccgctttacataagctgatgacgcctgattaata

SEQ ID NO: 1001 - DNA, 61 bp, Planctomycetes bacterium RIFCSPHIGHO2_02_FULL_38_41; identical to SEQ ID NO: 462
  misc_feature (1)..(61): MHYP01000280.1/7052-7112 Planctomycetes bacterium RIFCSPHIGHO2_02_FULL_38_41 rifcsphigho2_02_scaffold_83486, whole genome shotgun sequence

SEQ ID NO: 1002 - DNA, 68 bp, Niastella koreensis GR20-10
  misc_feature (1)..(68): CP003178.1/1777183-1777116 Niastella koreensis GR20-10, complete genome
tacccgcaaggaaatggtgtcttcctacttaaccgttccaaccaggaactgatggcgcctacaaatac

SEQ ID NO: 1003 - DNA, 63 bp, Mucilaginibacter mallensis strain MP1X4
  misc_feature (1)..(63): LT629740.1/2938316-2938254 Mucilaginibacter mallensis strain MP1X4 genome assembly, chromosome: I
ttagcagcaggaaatggtgtcttccttttaaaaaccgcgattgctgatggcgcctgcaaattc

SEQ ID NO: 1004 - DNA, 64 bp, Pseudonocardia sp. EC080619-01
  misc_feature (1)..(64): CP012184.1/4360830-4360893 Pseudonocardia sp. EC080619-01, complete genome
cccctcgacggcgatggggctccgccgacaaccgcccgcccgggctgatggctcctacccgacc

SEQ ID NO: 1005 - DNA, 69 bp, Candidatus Rokubacteria bacterium
  misc_feature (1)..(69): MNFC01000140.1/4478-4410 Candidatus Rokubacteria bacterium 13_1_40CM_4_69_5 13_1_40cm_4_scaffold_1285, whole genome shotgun sequence
gtagacgacggcgatggggttcgcccacaaccgccttggagtcgcgaggctgatgacccctaccaggca

SEQ ID NO: 1006 - DNA, 61 bp, Rhizobiales bacterium 65-79
  misc_feature (1)..(61): MKRJ01000017.1/44346-44406 Rhizobiales bacterium 65-79 SCNpilot_cont_1000_bf_scaffold_222, whole genome shotgun sequence
atttcacatggcgatggagttcgccttcgagcgccgatcggctgatgactccttgactgtc

SEQ ID NO: 1007 - DNA, 72 bp, Bifidobacterium mongoliense DSM 21395
  misc_feature (1)..(72): JGZE01000017.1/23163-23092 Bifidobacterium mongoliense DSM 21395 Contig17, whole genome shotgun sequence
gcagccagtggtgatggatcccgcccggacttcgtgtccaaaccgcataacgctgatggttcctactcaatc

SEQ ID NO: 1008 - DNA, 63 bp, Bacteroidia bacterium 44-10
  misc_feature (1)..(63): MKTE01000006.1/11315-11253 Bacteroidia bacterium 44-10 SCNpilot_bf_inoc_scaffold_1083, whole genome shotgun sequence
cactgtttcggcaatgggatctgcctttaaccgtccgccaggactgatgatacctactttttc

SEQ ID NO: 1009 - DNA, 76 bp, Betaproteobacteria bacterium RIFCSPLOWO2_12_FULL_63_13
  misc_feature (1)..(76): MERJ01000097.1/5928-6003 Betaproteobacteria bacterium RIFCSPLOWO2_12_FULL_63_13 rifcsplowo2_12_scaffold_19614, whole genome shotgun sequence
tgccccgaaggagatggcattcctccttcaataagcaacaagaaccgccgctacggctgatgatgcctacagattt

SEQ ID NO: 1010 - DNA, 63 bp, Bdellovibrionales bacterium RIFOXYD1_FULL_55_31
  misc_feature (1)..(63): MEQK01000145.1/1118-1180 Bdellovibrionales bacterium RIFOXYD1_FULL_55_31 rifoxyd1_full_scaffold_5117, whole genome shotgun sequence
ggaacctacggcaatggagtctgccttttaaccgccccttcggctgatgactcctactcaaac

SEQ ID NO: 1011 - DNA, 72 bp, Methylobacterium sp. Leaf93
  misc_feature (1)..(72): LMMS01000008.1/43799-43728 Methylobacterium sp. Leaf93 contig_16, whole genome shotgun sequence
gaaggctgcggcaatggattctgccgggcgcaaagccgaaccgccataagggctgatgattcctaacctttt

SEQ ID NO: 1012 - DNA, 68 bp, Sphingobacterium spiritivorum ATCC 33861
  misc_feature (1)..(68): GL379772.1/308520-308587 Sphingobacterium spiritivorum ATCC 33861 genomic scaffold SCAFFOLD3, whole genome shotgun sequence
aattaaaaaggaaatggtgttcttccttaaccaaaccgctttagcaagctgatgacgcctgattgata

SEQ ID NO: 1013 - DNA, 122 bp, Chroococcidiopsis thermalis PCC 7203 plasmid pCHRO.01
  misc_feature (1)..(122): CP003598.1/6135-6014 Chroococcidiopsis thermalis PCC 7203 plasmid pCHRO.01, complete sequence
attctatatggcaatggagcttgccaaaatcgccgcttcagttcgtgctaaatgttttaccagttatggctgtaaaacaaaagcttgtaactatctgaaaggctgatggctcctactttcca

SEQ ID NO: 1014 - DNA, 67 bp, Syntrophobacter fumaroxidans MPOB
  misc_feature (1)..(67): CP000478.1/3591388-3591322 Syntrophobacter fumaroxidans MPOB, complete genome
ttgaattgcggcgatgaagttcgccctgaaccgccccgggccaggggatgatgacttctacttcgaa

SEQ ID NO: 1015 - DNA, 67 bp, Alicyclobacillus hesperidum URH17-3-68 URH17368ctg23
  misc_feature (1)..(67): AKZN01000023.1/27052-26986 Alicyclobacillus hesperidum URH17-3-68 URH17368ctg23, whole genome shotgun sequence
caatttgttggtgatggagctcaccagaaccgtccacctgacgtggactgatagcccctacccgtgt

SEQ ID NO: 1016 - DNA, 62 bp, Atopostipes suicloacalis DSM 15692
  misc_feature (1)..(62): FQUF01000034.1/23465-23404 Atopostipes suicloacalis DSM 15692 genome assembly, contig: EJ15DRAFT_scaffold00033.33
ttaatcaaaagggatggtactccctataaccgccagaaatggctgatggtgcctgttatgta

SEQ ID NO: 1017 - DNA, 62 bp, Rhizobium sp. CF142
  misc_feature (1)..(62): AJWE01000036.1/40479-40540 Rhizobium sp. CF142 PMI11_contig_37.37, whole genome shotgun sequence
cagcccgatggggatggagtgcccccgaaaccgccctcaaggctgatgactcctaccgtgtt

SEQ ID NO: 1018 - DNA, 68 bp, Acinetobacter larvae strain BRTC-1 chromosome
  misc_feature (1)..(68): CP016895.1/3079667-3079734 Acinetobacter larvae strain BRTC-1 chromosome, complete genome
aattcttcaggagatggtcatcctcctctaacaaaccgccacgatcggctaatgatgcctacgtttcc

SEQ ID NO: 1019 - DNA, 70 bp, Elusimicrobia bacterium
  misc_feature (1)..(70): MNXB01000100.1/23160-23091 Elusimicrobia bacterium CG1_02_37_114 cg_0.2_sub10_scaffold_372_c, whole genome shotgun sequence
aaattaaaaggtgatgaggttcgcctacgaaccaccccgataaatcggggttgatgacctctactctgaa

SEQ ID NO: 1020 - DNA, 69 bp, Desulfacinum hydrothermale DSM 13146
  misc_feature (1)..(69): FWXF01000014.1/27835-27903 Desulfacinum hydrothermale DSM 13146 genome assembly, contig: EJ40DRAFT_scaffold00014.14
attgggaaaggcaaagaagtctgcctgaaccacctgcccaacgtgcaggttgatgacttctacccctgc

SEQ ID NO: 1021 - DNA, 73 bp, Clostridium sp. CAG:221
  misc_feature (1)..(73): FR883363.1/841-769 Clostridium sp. CAG:221 genomic scaffold, scf26
attaacgtagggaatgaagttctcccttgattaatatcaaaactgcgtaatagctgatgacttctacaacttt

SEQ ID NO: 1022 - DNA, 63 bp, Hyphomicrobium sp. MC1 chromosome
  misc_feature (1)..(63): FQ859181.1/1438924-1438986 Hyphomicrobium sp. MC1 chromosome, complete genome
gtaagcgatggggatggggttcccccgataaccgccattgtggctgatgactcctacgatagc

SEQ ID NO: 1023 - DNA, 72 bp, Chitinophaga ginsengisegetis strain DSM 18108
  misc_feature (1)..(72): FUZZ01000004.1/97869-97940 Chitinophaga ginsengisegetis strain DSM 18108 genome assembly, contig: LX61DRAFT_scaffold00004.4
cagataacaggaaatggtgtcttcctgacccaaaccgtcagcccagggctgtctgatggcgcctacaaatat

SEQ ID NO: 1024 - DNA, 70 bp, Flammeovirgaceae bacterium 311
  misc_feature (1)..(70): CP004371.1/4957776-4957845 Flammeovirgaceae bacterium 311, complete genome
gggcgtaaaggcaatggtgtctgcctcaaaccgcctgtagtattgtcaggatgatggcgcctgctcatcg

SEQ ID NO: 1025 - DNA, 62 bp, Crenobacter luteus strain CN10
  misc_feature (1)..(62): LQQU01000013.1/156749-156688 Crenobacter luteus strain CN10 contig_20, whole genome shotgun sequence
cgcagcgtgggagatggcatgcctccctaaccgcctttacggctgatgatgcctacacgcga

SEQ ID NO: 1026 - DNA, 71 bp, Minicystis rosea strain DSM 24000
  misc_feature (1)..(71): CP016211.1/3076023-3076093 Minicystis rosea strain DSM 24000, complete genome
agtcgggatggcggtggagtccgccgacaaccgtcgtcgcttccgcgacggccaatgactcctacgagcag

SEQ ID NO: 1027 - DNA, 68 bp, Belliella pelovolcani strain DSM 46698
  misc_feature (1)..(68): FTOP01000001.1/138850-138783 Belliella pelovolcani strain DSM 46698 genome assembly, contig: Ga0111625_101
tttttcataggcgatggggttccgccttacaaccgcccatttttggtgctgatgactcctacttcaac

SEQ ID NO: 1028 - DNA, 65 bp, Candidatus Sodalis pierantonius str. SOPE
  misc_feature (1)..(65): CP006568.1/1167260-1167196 Candidatus Sodalis pierantonius str. SOPE, complete genome
gacccttcaggagatgacattcctccttaataaccgccgttctggctgatgatgtctacgttcgc

SEQ ID NO: 1029 - DNA, 60 bp, Ornatilinea apprima strain P3M-1
  misc_feature (1)..(60): LGCL01000023.1/36324-36265 Ornatilinea apprima strain P3M-1 contig_9, whole genome shotgun sequence
caataatatggcgatgaggctcgctaaaactgtcacccgactgatggcctctactgagcg

SEQ ID NO: 1030 - DNA, 65 bp, Vibrio shilonii AK1 1103207002041
  misc_feature (1)..(65): ABCH01000002.1/2875-2939 Vibrio shilonii AK1 1103207002041, whole genome shotgun sequence
tgcaaccaaggtgatggggttccacctacttaaccgccaaatcggctgatgactcctacagtttc

SEQ ID NO: 1031 - DNA, 69 bp, Sphingobacteriales bacterium 44-61
  misc_feature (1)..(69): MKTW01000012.1/129407-129339 Sphingobacteriales bacterium 44-61 SCNpilot_expt_1000_bf_scaffold_47, whole genome shotgun sequence
tgcctgcaaggaaatggtgtcttcctactgaaccgttctttcttaagaactaatggcgcctacaaatta

SEQ ID NO: 1032 - DNA, 62 bp, Paenibacillus sp. IHB B 3415
  misc_feature (1)..(62): JUEI01000047.1/36496-36435 Paenibacillus sp. IHB B 3415 contig_047, whole genome shotgun sequence
attcaatacggcgatggagttcgccataaccgtccttcgggactaatgactcctaccagtga

SEQ ID NO: 1033 - DNA, 61 bp, Methanobacterium sp. SWAN-1
  misc_feature (1)..(61): CP002772.1/1977338-1977278 Methanobacterium sp. SWAN-1, complete genome
atttttacaggcgatggagttcacctttaaccgcgtcaacgctgatgactcctgctatcta

SEQ ID NO: 1034 - DNA, 65 bp, Methylovorus glucosetrophus SIP3-4
  misc_feature (1)..(65): CP001674.1/8629-8565 Methylovorus glucosetrophus SIP3-4, complete genome
acaggcggtggagatggcattcctcccttaaccgctgccttgcagctaatgatgcctacgataac

SEQ ID NO: 1035 - DNA, 75 bp, Cellulosimicrobium sp. MM
  misc_feature (1)..(75): JPQW01000201.1/1074-1148 Cellulosimicrobium sp. MM contig201, whole genome shotgun sequence
gctgggagcggtgatggatcccgccggggcgcagccgcccgaaccgccgccagggctgatggttcctgactcgtc

SEQ ID NO: 1036 - DNA, 71 bp, Granulicella tundricola MP5ACTX9
  misc_feature (1)..(71): CP002480.1/2557621-2557691 Granulicella tundricola MP5ACTX9, complete genome
cacaatcctggcgatggggttcgcctacgatgcccggctgtaaagccggcgctgatgactcctacatctcg

SEQ ID NO: 1037 - DNA, 77 bp, Verrucomicrobia bacterium; identical to SEQ ID NO: 510
  misc_feature (1)..(77): MNIL01000065.1/10116-10040 Verrucomicrobia bacterium 13_1_20CM_4_54_11 13_1_20cm_4_scaffold_189, whole genome shotgun sequence

SEQ ID NO: 1038 - DNA, 74 bp, Ruminococcus albus 8
  misc_feature (1)..(74): ADKM02000081.1/126-53 Ruminococcus albus 8 contig00134, whole genome shotgun sequence
agttcatacgggaatgatgttctcccacgggaaaccgaaaccgcttatcataagctgatgacttctgcgtttta

SEQ ID NO: 1039 - DNA, 72 bp, Deltaproteobacteria bacterium
  misc_feature (1)..(72): MGQI01000065.1/2868-2939 Deltaproteobacteria bacterium RBG_13_58_19 RBG_13_scaffold_17853, whole genome shotgun sequence
gcagacgaaggcgatgaagtccgccgcaaacgccccgggataggttccagggctgatgacttctgtccaacc

SEQ ID NO: 1040 - DNA, 79 bp, Tetrasphaera japonica T1-X7
  misc_feature (1)..(79): HF570958.1/3235724-3235802 Tetrasphaera japonica T1-X7 genomic scaffold, 1540_scaffold1
gtcggactcggtgatggatcccaccggggcgtgaggctcacgcccgaaccgcctcccggatgatggttcctgactcgtc

SEQ ID NO: 1041 - DNA, 69 bp, Syntrophus sp. GWC2_56_31
  misc_feature (1)..(69): MICN01000022.1/2896-2964 Syntrophus sp. GWC2_56_31 gwc2_scaffold_15257, whole genome shotgun sequence
ttcattgatggggatggagtcccccgctgtaaaacgcttcttaacagagctgatgactcctgctgcacg

SEQ ID NO: 1042 - DNA, 68 bp, Nitrospirae bacterium
  misc_feature (1)..(68): MNYV01000167.1/9181-9114 Nitrospirae bacterium CG2_30_53_67 cg2_3.0_scaffold_6689_c, whole genome shotgun sequence
aaaaaagtcggcgatggagttcgccgttgactgcttccccaaacgaagctgatgactcctactcttta

SEQ ID NO: 1043 - DNA, 82 bp, Dyella jiangningensis strain SBZ 3-12
  misc_feature (1)..(82): CP007444.1/824586-824505 Dyella jiangningensis strain SBZ 3-12, complete genome
gcccgccagggagatggcatgcctcccgctccgacttgcgtacggggcgaaccaccttcgggttgatgatgcctgcaccacc

SEQ ID NO: 1044 - DNA, 68 bp, Candidimonas bauzanensis strain CGMCC 1.10190
  misc_feature (1)..(68): FQXE01000023.1/8132-8065 Candidimonas bauzanensis strain CGMCC 1.10190 genome assembly, contig: Ga0070552_123
actctttacggagatggcattcctcctttaaccatcggcgcaagccgattgatgatgcctacaggtcc

SEQ ID NO: 1045 - DNA, 64 bp, Andreprevotia lacus DSM 23236
  misc_feature (1)..(64): FWXD01000003.1/194430-194367 Andreprevotia lacus DSM 23236 genome assembly, contig: BR64DRAFT_scaffold00003.3
gcagggtacggagatggcattcctccccaaaccgccctgaccggctgatgatgcctgcacacgt

SEQ ID NO: 1046 - DNA, 63 bp, Clostridiales bacterium
  misc_feature (1)..(63): LAKY01000073.1/82222-82160 Clostridiales bacterium PH28_bin88 ph28_926, whole genome shotgun sequence
aacgaaataggcgatggagctcgccttaaccactgccaagcagttgatggctcctaccgggga

SEQ ID NO: 1047 - DNA, 79 bp, Bradyrhizobium manausense strain BR3351
  misc_feature (1)..(79): LJYG01000104.1/286389-286467 Bradyrhizobium manausense strain BR3351 contig2104, whole genome shotgun sequence
ccgacagatggggatggagtcccccgacaaccgcccggcggtcgcgcgactgcaatgggctgatgactcctgccgaagg

SEQ ID NO: 1048 - DNA, 65 bp, Propionispora sp. 2/2-37 isolate 2/2-37
  misc_feature (1)..(65): CYSP01000014.1/96818-96882 Propionispora sp. 2/2-37 isolate 2/2-37 genome assembly, contig: 2/2_contig14
cgacaatcgggcgatggagttcgccgtaaccccgcagtgaaagcggtaataactcctaccttccc

SEQ ID NO: 1049 - DNA, 61 bp, Paenibacillus pini JCM 16418
  misc_feature (1)..(61): BAVZ01000004.1/149938-149878 Paenibacillus pini JCM 16418 DNA, contig: contig00004
ataaagaaaggcgatggagttcgccataactgccttcgtggctaatgactcctaccgggga

SEQ ID NO: 1050 - DNA, 80 bp, Komagataeibacter nataicola strain RZS01
  misc_feature (1)..(80): CP019875.1/3028593-3028672 Komagataeibacter nataicola strain RZS01, complete genome
aacgaacacggcaatggattctgccggaccatgctggtcgaaccgctgcccgcaagggcgctgatgattcctgcccactg

SEQ ID NO: 1051 - DNA, 72 bp, Bifidobacterium psychraerophilum strain LMG 21775
  misc_feature (1)..(72): JGZI01000010.1/395195-395266 Bifidobacterium psychraerophilum strain LMG 21775 Contig10, whole genome shotgun sequence
atcgggtctggcgatggaacccgccgggagctctgctccgaaccgcataccgctgatagttcctacccgtcc

SEQ ID NO: 1052 - DNA, 78 bp, Candidatus Nitrosotalea devanaterra
  misc_feature (1)..(78): LN890280.1/1321626-1321549 Candidatus Nitrosotalea devanaterra genome assembly, chromosome: 1
ctcaaagaaggctatgacattagccttggaagattcctaaaccgctcctagaaaggtgctgataatgtctacctaatg

SEQ ID NO: 1053 - DNA, 73 bp, Eubacterium sp. CAG:86
  misc_feature (1)..(73): HF987625.1/77121-77193 Eubacterium sp. CAG:86 genomic scaffold, scf291
ttacaagttgggaatgaagttctcccatgggaaacctaaactgcttattatagctgatgacttctacgatttt

SEQ ID NO: 1054 - DNA, 66 bp, Crenobacter luteus strain CN10
  misc_feature (1)..(66): LQQU01000013.1/158638-158573 Crenobacter luteus strain CN10 contig_20, whole genome shotgun sequence
gctgctgcaggagatggcattcctcctcataaccgccccgatcgggctgatgatgcctatggtatt

SEQ ID NO: 1055 - DNA, 69 bp, Burkholderia glumae PG1 chromosome 2
  misc_feature (1)..(69): CP002581.1/2902006-2901938 Burkholderia glumae PG1 chromosome 2, complete sequence
ccgcgcttcggagatggcatgcctccgcccccaaccgccggtcagccggctgatgatgcctacggatcc

SEQ ID NO: 1056 - DNA, 62 bp, Thermotoga lettingae TMO
  misc_feature (1)..(62): CP000812.1/982299-982238 Thermotoga lettingae TMO, complete genome
aataagcctggtgatggagtccaccgttatttgccttaaaggctgatgactcctacttgaat

SEQ ID NO: 1057 - DNA, 63 bp, Hyphomicrobium denitrificans 1NES1
  misc_feature (1)..(63): CP005587.1/218662-218724 Hyphomicrobium denitrificans 1NES1, complete genome
ggcggcgatggggatggggttcccccgataaccgcccatatggctgatgactcctagcaaagc

SEQ ID NO: 1058 - DNA, 75 bp, Clostridium sp. 7_2_43FAA
  misc_feature (1)..(75): JH815222.1/1329237-1329163 Clostridium sp. 7_2_43FAA genomic scaffold supercont2.3, whole genome shotgun sequence
agactttaagggaatgaagttctcccttgacttatgtctaaaccgctttggtaagctaatgacttctgcaagttt

SEQ ID NO: 1059 - DNA, 62 bp, Ignavibacteria bacterium RIFOXYC2_FULL_35_21
  misc_feature (1)..(62): MHAY01000034.1/50235-50296 Ignavibacteria bacterium RIFOXYC2_FULL_35_21 rifoxyc2_full_scaffold_216, whole genome shotgun sequence
tgtaacattggcgatggagttcgccattgaacgctgataaagctgatgactcctgttaaaag

SEQ ID NO: 1060 - DNA, 78 bp, Bifidobacterium adolescentis ATCC 15703
  misc_feature (1)..(78): AP009256.1/922963-923040 Bifidobacterium adolescentis ATCC 15703 DNA, complete genome
ctggactgcggtgatgggactcgcctgaagccgttacaggcttcgaaccgcaaacccgctgatggttcctacgacata

SEQ ID NO: 1061 - DNA, 57 bp, Peptococcaceae bacterium
  misc_feature (1)..(57): LADO01000039.1/59871-59815 Peptococcaceae bacterium BRH_c4b BRHa_1004828, whole genome shotgun sequence
aatacaagcggcgatggagctcgcctaatgcgttgcgctgatggcttctgccgggct

SEQ ID NO: 1062 - DNA, 62 bp, Acidothermus cellulolyticus 11B
  misc_feature (1)..(62): CP000481.1/805841-805902 Acidothermus cellulolyticus 11B, complete genome
actgaacgcggcgatgaagcccgccgacaatgcgccgcccggctgatggcttctaccgagtt

SEQ ID NO: 1063 - DNA, 81 bp, Singulisphaera acidiphila DSM 18658
  misc_feature (1)..(81): CP003364.1/4855682-4855762 Singulisphaera acidiphila DSM 18658, complete genome
ctgaataatggcgatggggttcgccaatcaataaccgccgcagcctcgtggaaggttgcggctgatgacccctacctttgg

SEQ ID NO: 1064 - DNA, 63 bp, Geobacillus sp. B4113_201601
  misc_feature (1)..(63): LQYX01000074.1/163851-163913 Geobacillus sp. B4113_201601 NODE_219, whole genome shotgun sequence
aacttcataggcgatggagttcgccataaccgccggtttccggctgatgactcctgctgcgaa

SEQ ID NO: 1065 - DNA, 55 bp, Lactobacillus rhamnosus MTCC 5462
  misc_feature (1)..(55): AEYM01000898.1/830-776 Lactobacillus rhamnosus MTCC 5462 contig1806, whole genome shotgun sequence
gaattaaatggcgatggtgttcgcctatacgtaagttgatgacacctaccttgta

SEQ ID NO: 1066 - DNA, 91 bp, Bifidobacterium mongoliense DSM 21395 Contig20
  misc_feature (1)..(91): JGZE01000020.1/9653-9563 Bifidobacterium mongoliense DSM 21395 Contig20, whole genome shotgun sequence
ggtgagcatgggtatgaagttacccaagatagtttgtcgcggtcgtgatgagcgtctgaaccgctgttaggctgatgacttctgcagagat

SEQ ID NO: 1067 - DNA, 63 bp, Pseudaminobacter manganicus strain JH-7 JH-7
  misc_feature (1)..(63): MDET01000013.1/67506-67568 Pseudaminobacter manganicus strain JH-7 JH-7_scaffold20, whole genome shotgun sequence
gacaataatggggatggggttcccccgataaccgccgcgaaggctgatgactcctaccgggcg

SEQ ID NO: 1068 - DNA, 77 bp, Clostridium sp. CAG:7
  misc_feature (1)..(77): HF990711.1/3779-3703 Clostridium sp. CAG:7 genomic scaffold, scf172
ataagcgccgggaatgaagttctcccaagggaaacctgaaccgcttagaaatgtaagctgatgacttctgtgatgaa

SEQ ID NO: 1069 - DNA, 62 bp, Mycobacterium sherrisii strain BC1_M4
  misc_feature (1)..(62): MIHC01000025.1/15383-15322 Mycobacterium sherrisii strain BC1_M4 PROKKA_contig000025, whole genome shotgun sequence
atgggagaaggcggtggggctcgccgaaaccgcagactagtgccaatagcccctgcggtctg

SEQ ID NO: 1070 - DNA, 87 bp, Lachnospiraceae bacterium 3_1_57FAA_CT1
  misc_feature (1)..(87): KE150405.1/570283-570197 Lachnospiraceae bacterium 3_1_57FAA_CT1 genomic scaffold acsNU-supercont1.1, whole genome shotgun sequence
tcgaagattggaaatgaagttcttccatggtaccggataccaacggattacctaaaccgcttgacagctgatgacttctgcgacaaa

SEQ ID NO: 1071 - DNA, 76 bp, Xanthomonas campestris pv. campestris str. ATCC 33913
  misc_feature (1)..(76): AE008922.1/2322664-2322589 Xanthomonas campestris pv. campestris str. ATCC 33913, complete genome
ggccatctcggagatggcgttcctccgcgctgtaccatcaaccgtagcgatcgctactgatgacgcctacaagaac

SEQ ID NO: 1072 - DNA, 75 bp, Mycobacterium heidelbergense strain DSM 44471
  misc_feature (1)..(75): MVHR01000005.1/164269-164343 Mycobacterium heidelbergense strain DSM 44471 NODE_5_length_243907_cov_56.1658, whole genome shotgun sequence
actggcatcggcgatggcgctcgccggaaagctctgctttcgaaccgccacacggctgatggcacctgcgaacgc

SEQ ID NO: 1073 - DNA, 64 bp, Caldicellulosiruptor saccharolyticus DSM 8903
  misc_feature (1)..(64): CP000679.1/751276-751339 Caldicellulosiruptor saccharolyticus DSM 8903, complete genome
tgctgcaacggcgagggagtccgccgaacaaatgccaatgatggctgatgactcctacaaatat

SEQ ID NO: 1074 - DNA, 61 bp, Nitrobacter hamburgensis X14
  misc_feature (1)..(61): CP000319.1/1049491-1049431 Nitrobacter hamburgensis X14, complete genome
ctggaaacagggaatggtgtctccctttcaccgccgactggctgatgactcctgctgactg

SEQ ID NO: 1075 - DNA, 76 bp, Serratia marcescens subsp. marcescens Db11
  misc_feature (1)..(76): HG326223.1/1779972-1779897 Serratia marcescens subsp. marcescens Db11, complete genome
cgttcacaaggtgatggtgttccacctttcccaaccgccgcgttcgctcgaaccggatgatgacgcctgatataca

SEQ ID NO: 1076 - DNA, 73 bp, Enterococcus casseliflavus EC20
  misc_feature (1)..(73): CP004856.1/2179184-2179256 Enterococcus casseliflavus EC20, complete genome
atgctaatagggaatgaatgtctccctcagttcttactgaaaccgcaattttgctaatgacttctaccacttt

SEQ ID NO: 1077 - DNA, 73 bp, Erwinia tasmaniensis strain ET1/99 complete chromosome
  misc_feature (1)..(73): CU468135.1/2891609-2891537 Erwinia tasmaniensis strain ET1/99 complete chromosome
gtatcacaaggtgatggtgctccacctttcccaaccgccctgattttttcgggctgatgacgcctgataaaac

SEQ ID NO: 1078 - DNA, 64 bp, Lactobacillus selangorensis strain DSM 13344
  misc_feature (1)..(64): JQAZ01000005.1/41654-41591 Lactobacillus selangorensis strain DSM 13344 Scaffold5, whole genome shotgun sequence
tagaaaatagggcatggtgttcgcccgatgaaactgcatgaatgctgatgacacctatccggag

SEQ ID NO: 1079 - DNA, 64 bp, Gemmatimonadetes bacterium 13_1_40CM_66_11
  misc_feature (1)..(64): MNEM01000075.1/10149-10212 Gemmatimonadetes bacterium 13_1_40CM_66_11 13_1_40cm_scaffold_3648, whole genome shotgun sequence
ttgctcgcaggcgatggagttcgccttcaaccgccctttacggactgatgactcctacctgaac

SEQ ID NO: 1080 - DNA, 70 bp, Thermodesulfovibrio yellowstonii DSM 11347
  misc_feature (1)..(70): CP001147.1/1737215-1737284 Thermodesulfovibrio yellowstonii DSM 11347, complete genome
tttaaaaaaggcgatggagttcgcctgtaagtgcctctgattttcaggggctgataactcctaccttaaa

SEQ ID NO: 1081 - DNA, 68 bp, Deltaproteobacteria bacterium
  misc_feature (1)..(68): MNYH01000071.1/560-627 Deltaproteobacteria bacterium CG2_30_66_27 cg2_3.0_scaffold_10978_c, whole genome shotgun sequence
cgaaaaaacggcgatggagttcgccgataaccgctgtcgttcggacggctgatgactcctgcccggtc

SEQ ID NO: 1082 - DNA, 61 bp, Paenibacillus sp. FSL R7-0331
  misc_feature (1)..(61): CP009284.1/5388823-5388763 Paenibacillus sp. FSL R7-0331, complete genome
gaagataagggcgatggagttcgccattaactgccgcgaggctaatgactcctaccagcga

SEQ ID NO: 1083 - DNA, 76 bp, Natranaerobius thermophilus JW/NM-WN-LF
  misc_feature (1)..(76): CP001034.1/285558-285483 Natranaerobius thermophilus JW/NM-WN-LF, complete genome
ggatttgacggcgatggagctcgccaggattaaattccaaactgctttcttagaagctaatggctcctaccctatc

SEQ ID NO: 1084 - DNA, 59 bp, Leptolinea tardivitalis strain YMTK-2
  misc_feature (1)..(59): LGCK01000014.1/708466-708524 Leptolinea tardivitalis strain YMTK-2 contig_1, whole genome shotgun sequence
acttagtttggcgatgaggctcgctcaaccgtcatgtgactgatagcttctactatttt

SEQ ID NO: 1085 - DNA, 63 bp, Deltaproteobacteria bacterium GWD2_55_8
  misc_feature (1)..(63): MGPZ01000034.1/11145-11207 Deltaproteobacteria bacterium GWD2_55_8 gwd2_scaffold_1402, whole genome shotgun sequence
tctattcgcggagatggcgttctcctttaaccgcctgccagggctgatgacgcctgaattcat

SEQ ID NO: 1086 - DNA, 66 bp, Lactobacillus brevis subsp. gravesensis ATCC 27305
  misc_feature (1)..(66): GG669604.1/320287-320352 Lactobacillus brevis subsp. gravesensis ATCC 27305 genomic scaffold SCAFFOLD1, whole genome shotgun sequence
aattaatatggcgatgacgttcgcctatactcgtttaataaaagagttgatgacgtctacctttat

SEQ ID NO: 1087 - DNA, 65 bp, Alicyclobacillus sp. USBA-503
  misc_feature (1)..(65): FRAF01000044.1/3382-3318 Alicyclobacillus sp. USBA-503 genome assembly, contig: Ga0105849_144
aaaataaaaggtgatggagctcaccataaactgccaactggttggctaatggctcctacggataa

SEQ ID NO: 1088 - DNA, 73 bp, Mycobacterium abscessus subsp. abscessus strain 57
  misc_feature (1)..(73): FSGV01000012.1/99309-99237 Mycobacterium abscessus subsp. abscessus strain 57 genome assembly, contig: ERS244815SCcontig000012
ttcgtcaggcgcgatggatctcgccagggcttgtcccgaaccgccactgacggctgatagttcctgtgttgat

SEQ ID NO: 1089 - DNA, 70 bp, Desulfomonile tiedjei DSM 6799
  misc_feature (1)..(70): CP003360.1/869588-869519 Desulfomonile tiedjei DSM 6799, complete genome
ctcgcacgaggcaatggagtctgcctaattaaccgccgagccggattcggctgatgactcctactgttca

SEQ ID NO: 1090 - DNA, 67 bp, Izhakiella sp. D4N98
  misc_feature (1)..(67): MRUL01000002.1/549750-549816 Izhakiella sp. D4N98 NODE_2_length_554444_cov_106.828_ID_1989, whole genome shotgun sequence
cccaccacgggtgatggcgttccacctgccccaaccgcccttctgggctgatgacgcctggcaaact

SEQ ID NO: 1091 - DNA, 68 bp, Niastella vici strain DJ57
  misc_feature (1)..(68): LVYD01000065.1/51211-51278 Niastella vici strain DJ57 contig36, whole genome shotgun sequence
ttcaagtagggtgatggcgttccacctaattaaccgcctttcggaaggacgatgacgcctacaggttg

SEQ ID NO: 1092 - DNA, 78 bp, Zymomonas mobilis subsp. mobilis ZM4
  misc_feature (1)..(78): AE008692.2/542148-542071 Zymomonas mobilis subsp. mobilis ZM4, complete genome
tatagacaaggtaatggaatctacctgatcctttctatggatcgaaccgccctttaggctgatgactcctgctcaaac

SEQ ID NO: 1093 - DNA, 67 bp, Chryseobacterium gleum ATCC 35910
  misc_feature (1)..(67): GL379781.1/3860594-3860660 Chryseobacterium gleum ATCC 35910 genomic scaffold SCAFFOLD1, whole genome shotgun sequence
aagaaaaaaggaaatggtgttcttccttacccaaccgctctaaagagctgatgacgcctgattaaat

SEQ ID NO: 1094 - DNA, 61 bp, Lactobacillus kefiranofaciens subsp. kefirgranum DSM 10550
  misc_feature (1)..(61): AZEM01000025.1/51232-51172 Lactobacillus kefiranofaciens subsp. kefirgranum DSM 10550 = JCM 8572 strain DSM 10550 NODE_34, whole genome shotgun sequence
aaatgaataggcgatgacgttcgccattaaatgagcaaaatctaatgacgtctactattta

SEQ ID NO: 1095 - DNA, 73 bp, Clostridium sp. CAG:253
  misc_feature (1)..(73): FR887307.1/81021-80949 Clostridium sp. CAG:253 genomic scaffold, scf163
aacgagtgagggaatgaagttctcccgaggaaaacctaaattgcttataatagctgatgacttctacgattat

SEQ ID NO: 1096 - DNA, 106 bp, Erwinia carotovora subsp. atroseptica SCRI1043
  misc_feature (1)..(106): BX950851.1/1468958-1468853 Erwinia carotovora subsp. atroseptica SCRI1043, complete genome
cactaaagcggagatgacattcctccctaccctaacgccgccaaaaatgctggcagcctgaagtacaaggtacaaccgccacccggctgatgatgtctacgtccac

SEQ ID NO: 1097 - DNA, 68 bp, Chromatiales bacterium USCg_Taylor
  misc_feature (1)..(68): MUGK01000091.1/13066-12999 Chromatiales bacterium USCg_Taylor scaffold_90, whole genome shotgun sequence
aacgctacaggagatggcatgcctcctgaccaacaaccgccgtttcggctgatgatgcctacgtgttc

SEQ ID NO: 1098 - DNA, 101 bp, Rhodanobacter sp. B05
  misc_feature (1)..(101): MUNU01000019.1/461039-461139 Rhodanobacter sp. B05 NODE_1_length_645680_cov_11.9856_ID_1, whole genome shotgun sequence
ggccgcgtgggagatggcatgcctcccgttccggcgcgactgtcgcgggacaaaccacctcccgtgcgacccacgtcgaggttgatgatgcctgcatcgcc

SEQ ID NO: 1099 - DNA, 70 bp, Candidatus Rokubacteria bacterium
  misc_feature (1)..(70): MNFC01000140.1/1400-1331 Candidatus Rokubacteria bacterium 13_1_40CM_4_69_5 13_1_40cm_4_scaffold_1285, whole genome shotgun sequence
gcacgaagcggcgatggggttcgcctgaaaccgccccgccggatgcgaggctgatgacccctaccggaag

SEQ ID NO: 1100 - DNA, 103 bp, Lunatimonas lonarensis strain AK24
  misc_feature (1)..(103): AQHR01000110.1/102878-102980 Lunatimonas lonarensis strain AK24 S14_contig_28, whole genome shotgun sequence
tgcccatcgggtgatggggtgccacccaaatatcagggacttatccgaagttttctgattttttgaaccgcttcgcaagaatgctgatgactcctacttcaac

SEQ ID NO: 1101 - DNA, 85 bp, Chthonomonas calidirosea T49
  misc_feature (1)..(85): HF951689.1/2127795-2127711 Chthonomonas calidirosea T49 complete genome
ttgaaccttggcgatggaggccgccagggcgcttgtttttgctgcccaaaccgctctcttttgagctgatggctcctagctcaca

SEQ ID NO: 1102 - DNA, 76 bp, Acidomonas methanolica NBRC 104435
  misc_feature (1)..(76): BAND01000009.1/6045-5970 Acidomonas methanolica NBRC 104435 DNA, contig: Amme_009
gtcggaattggcaatggactctgcctgacctgcaaaggtcgaaccgcccgcgagggctgatgattcctacctcgcc

SEQ ID NO: 1103 - DNA, 107 bp, Methanobacterium sp. A39
  misc_feature (1)..(107): LZPM01000042.1/12528-12634 Methanobacterium sp. A39 contig_5, whole genome shotgun sequence
ataataataggtgatggagttcacctttaactgcttatttaagctggatcaataaattgatcaaaatataaaccgcttatttttaagctgatgactcctaccaagat

SEQ ID NO: 1104 - DNA, 62 bp, Burkholderiales bacterium 70-64
  misc_feature (1)..(62): MKUQ01000060.1/73481-73542 Burkholderiales bacterium 70-64 SCNpilot_expt_1000_bf_scaffold_93, whole genome shotgun sequence
cttcacatgggagatggcatgcctccccgaaccgcctgacggctgatgatgcctaccgatcg

SEQ ID NO: 1105 - DNA, 59 bp, Lactobacillus vini DSM 20605
  misc_feature (1)..(59): AYYX01000035.1/16618-16560 Lactobacillus vini DSM 20605 Scaffold35, whole genome shotgun sequence
ttgattttaggtgatgacgttcaccgttaaaccaatttattaatgacgtctgtttaagg

SEQ ID NO: 1106 - DNA, 71 bp, Terriglobus roseus DSM 18391
  misc_feature (1)..(71): CP003379.1/1270075-1270145 Terriglobus roseus DSM 18391, complete genome
cacctgcgtggcgttggggttccgccagaaccgcacgcggcctggccgctgctgatgactcctacgaatcg

SEQ ID NO: 1107 - DNA, 62 bp, Paenibacillus sp. 11
  misc_feature (1)..(62): FXAZ01000009.1/141555-141494 Paenibacillus sp. 11 genome assembly, contig: Ga0139009_109
cattatataggcgatggagttcgccgtataaccgccgcgaggctaatgactcctaccagaga

SEQ ID NO: 1108 - DNA, 59 bp, Moorella glycerini strain NMP
  misc_feature (1)..(59): CELZ01000050.1/69316-69258 Moorella glycerini strain NMP genome assembly, contig: M_glycerini_NMP_DRAFT_scaffold-50
aaccccaacggcgatggagctcgcctaacgctcagtgagctaatagctcctaccgaaag

SEQ ID NO: 1109 - DNA, 72 bp, Sneathia amnii strain SN35
  misc_feature (1)..(72): CP011280.1/1051708-1051637 Sneathia amnii strain SN35, complete genome
aatgaaattggagatgaagttctccatgattaaatatcaaaactgctttatgctaatgacttctacactaag

SEQ ID NO: 1110 - DNA, 93 bp, Clostridium sp. CAG:1024
  misc_feature (1)..(93): HF985409.1/884-792 Clostridium sp. CAG:1024 genomic scaffold, scf148
aaaaaagatgggaatgaggttctcccgcggcaggacgcagcttgcgccttgccggaaccgccggcacttccgactgatgacttctcatgcgcc

SEQ ID NO: 1111 - DNA, 62 bp, Paenibacillus sp. FSL R5-0912; identical to SEQ ID NO: 1032
  misc_feature (1)..(62): CP009282.1/1122616-1122555 Paenibacillus sp. FSL R5-0912, complete genome

SEQ ID NO: 1112 - DNA, 81 bp, Spirochaetes bacterium GWC2_52_13
  misc_feature (1)..(81): MIAV01000034.1/16563-16483 Spirochaetes bacterium GWC2_52_13 gwc2_scaffold_337, whole genome shotgun sequence
tgcgctacaggcgatggggttcgcctctacctgacaaggtcgcaaccgtggacactgtccactgataactcctacccatca

SEQ ID NO: 1113 - DNA, 62 bp, Mycobacterium xenopi 3993
  misc_feature (1)..(62): JAOC01000010.1/317039-316978 Mycobacterium xenopi 3993 GMX3993.contig.9, whole genome shotgun sequence
atcaggccaggcgatgaagctcgccttgaccgccaccaaaggctgatggcttctaccacaga

SEQ ID NO: 1114 - DNA, 64 bp, Photobacterium jeanii strain R-40508
  misc_feature (1)..(64): LVHF01000033.1/31222-31285 Photobacterium jeanii strain R-40508 scaffold9, whole genome shotgun sequence
tttggcaaaggtgatggggttccacctacttaaccgccatgtggctgatgactcctacagaaaa

SEQ ID NO: 1115 - DNA, 75 bp, Ruminococcus albus 7
  misc_feature (1)..(75): CP002403.1/1537238-1537164 Ruminococcus albus 7, complete genome
atatcgtatgggaatgatagtctcccgaggttttacctgaactgcttattctgagctgatgacatctgcaatacg

SEQ ID NO: 1116 - DNA, 73 bp, Alkaliphilus oremlandii OhILAs
  misc_feature (1)..(73): CP000853.1/1242223-1242295 Alkaliphilus oremlandii OhILAs, complete genome
atttctatagggaatgaagttctcccttggcaatagcctaaaccgcaaatatgctgatgacttctgcgaaaat

SEQ ID NO: 1117 - DNA, 67 bp, Nitrosomonas europaea ATCC 19718
  misc_feature (1)..(67): AL954747.1/1838968-1838902 Nitrosomonas europaea ATCC 19718, complete genome
ataataattggagatggcattcctccattaaccgccgcaatctgtggctgatgatgcctacgactgg

SEQ ID NO: 1118 - DNA, 74 bp, Desulfobacca acetoxidans DSM 11109
  misc_feature (1)..(74): CP002629.1/3040536-3040463 Desulfobacca acetoxidans DSM 11109, complete genome
atgtaaactggcgatggggtccgccttcaaccgcctgaagcaaatgttttcgggatgatgacttctactgggat

SEQ ID NO: 1119 - DNA, 75 bp, Eubacterium ventriosum ATCC 27560 Scfld0224
  misc_feature (1)..(75): DS264286.1/287218-287292 Eubacterium ventriosum ATCC 27560 Scfld0224 genomic scaffold, whole genome shotgun sequence
taaataaaagggaatgaggttctccctcgatttaatcgaaaccgcttataacaagctgatgacttctgtgcaata

SEQ ID NO: 1120 - DNA, 63 bp, Deltaproteobacteria bacterium RIFOXYD12_FULL_50_9
  misc_feature (1)..(63): MGTA01000258.1/277-339 Deltaproteobacteria bacterium RIFOXYD12_FULL_50_9 rifoxyd3_full_scaffold_874, whole genome shotgun sequence
atgcaatgcggtgatggagtccacctttaaccgccggaaatggctgatgactcctaccaggat

SEQ ID NO: 1121 - DNA, 74 bp, Facklamia languida CCUG 37842
  misc_feature (1)..(74): JH601133.1/698518-698445 Facklamia languida CCUG 37842 genomic scaffold supercont1.1, whole genome shotgun sequence
tgaaaccaaggaaatgaagtgcttcctttcgttgacgataaaccgccgtgttggctgatgacttctgtaggctt

SEQ ID NO: 1122 - DNA, 80 bp, Ruminococcus obeum CAG:39
  misc_feature (1)..(80): FR896817.1/33673-33594 Ruminococcus obeum CAG:39 genomic scaffold, scf184
aaatataaagagaatgaggttctccctaagtaataaaattacttaaaccgcttatgaaagctgatgacttctgcgagtaa

SEQ ID NO: 1123 - DNA, 78 bp, Corchorus olitorius cultivar O-4
  misc_feature (1)..(78): AWUE01002742.1/2094-2171 Corchorus olitorius cultivar O-4 contig02744, whole genome shotgun sequence
gagccttgcggagatggcatgcctcccttaaccgccggtctgcggatgacgcgtccggctgatgatgcctacaagttc

SEQ ID NO: 1124 - DNA, 59 bp, Clostridium ultunense Esp
  misc_feature (1)..(59): HG764817.1/4224730-4224788 Clostridium ultunense Esp genomic scaffold, CULT_3033
ataaataatggtgatggggttcaccaaaatcgcttaatgctaatgactcctacaggaat

SEQ ID NO: 1125 - DNA, 65 bp, Alicyclobacillus macrosporangiidus strain DSM 17980
  misc_feature (1)..(65): FPBV01000005.1/42076-42140 Alicyclobacillus macrosporangiidus strain DSM 17980 genome assembly, contig: Ga0104483_105
acgcgaatcggcgatgaggctcgccacaaccgtctgccagacagactgatgactcctgcccggcg

SEQ ID NO: 1126 - DNA, 62 bp, Peptococcaceae bacterium SCADC1_2_3
  misc_feature (1)..(62): JJNX02000028.1/24007-24068 Peptococcaceae bacterium SCADC1_2_3 contig_28, whole genome shotgun sequence
tatgacatagggaatgaagtctccctcataaatgccaattggctgatgacttctgcagaaaa

SEQ ID NO: 1127 - DNA, 68 bp, Lactobacillus acidipiscis strain DSM 15353
  misc_feature (1)..(68): JQBK01000090.1/3619-3552 Lactobacillus acidipiscis strain DSM 15353 Scaffold90, whole genome shotgun sequence
atgttttctggtgatgacgttcaccagtccaaaaatccgtgctcccacgtaatgacgtctaagtgaat

SEQ ID NO: 1128 - DNA, 74 bp, Blautia sp. CAG:237
  misc_feature (1)..(74): FR886704.1/8190-8263 Blautia sp. CAG:237 genomic scaffold, scf90
acccgaattgggaatgaagttctcccatgggaaacctaaactgcttattcagagctgatgacttctacgattat

SEQ ID NO: 1129 - DNA, 65 bp, Candidimonas bauzanensis strain CGMCC 1.10190
  misc_feature (1)..(65): FQXE01000008.1/8211-8275 Candidimonas bauzanensis strain CGMCC 1.10190 genome assembly, contig: Ga0070552_108
tgtgttacaggagatggcattcctccttataaccgcccaaaccggctgatgatgcctaccaaact

SEQ ID NO: 1130 - DNA, 63 bp, Planctomycetes bacterium
  misc_feature (1)..(63): MHYG01000119.1/1324-1262 Planctomycetes bacterium RBG_13_62_9 RBG_13_scaffold_24815, whole genome shotgun sequence
actgatcgtggggatggagtcccccggacaaccgcctgcagggctgatgactcctaccggttt

SEQ ID NO: 1131 - DNA, 63 bp, Acidobacteria bacterium RIFCSPLOWO2_12_FULL_60_22
  misc_feature (1)..(63): MEKZ01000322.1/5576-5514 Acidobacteria bacterium RIFCSPLOWO2_12_FULL_60_22 rifcsplowo2_12_scaffold_52111, whole genome shotgun sequence
ntacccgggggtgatggggttcacccaaaccgtccgctagggactgatgacccctgccgactg

SEQ ID NO: 1132 - DNA, 108 bp, Gordonia sp. NB4-1Y
  misc_feature (1)..(108): APHK02000086.1/1858-1751 Gordonia sp. NB4-1Y contig_86, whole genome shotgun sequence
attggtcgcggcgatggatctcgccggaggccggccccgatgacgggaccccggcccgaaccgcctccaccggggtgacccggaccggctgatagttcctgttccgat

SEQ ID NO: 1133 - DNA, 61 bp, Desulfosporosinus sp. BRH_c37 BRHa_1005612
  misc_feature (1)..(61): LOEW01000239.1/52785-52725 Desulfosporosinus sp. BRH_c37 BRHa_1005612, whole genome shotgun sequence
gttatttcaggtgatgggactcaccttataaaggccaacagctaatggctcctactttcaa

SEQ ID NO: 1134 - DNA, 80 bp, Elusimicrobia bacterium RIFOXYA2_FULL_58_8
  misc_feature (1)..(80): MGVH01000034.1/1081-1160 Elusimicrobia bacterium RIFOXYA2_FULL_58_8 rifoxya2_full_scaffold_1728, whole genome shotgun sequence
ccgtacatcggcgatgatgtccgccgcaccgccggaacgcggtgaaaccgtccgcggggactgatgacctctaccgaaga

SEQ ID NO: 1135 - DNA, 89 bp, Rhizobium sp. AC27/96 AS1I6_9
  misc_feature (1)..(89): LXKN01000075.1/60798-60710 Rhizobium sp. AC27/96 AS1I6_9, whole genome shotgun sequence
aaatccaacggtaatggatttctgccgggccatggtggccgaaccgctgctctgaattttccagggaagctgatgactcctactcaaca

SEQ ID NO: 1136 - DNA, 77 bp, Gordonia bronchialis DSM 43247
  misc_feature (1)..(77): CP001802.1/3683321-3683245 Gordonia bronchialis DSM 43247, complete genome
tgatcgtcgggtgatggatctccgcccggagggtttcctccgaaccgccgatgtcggctgatggctcctgttccgat

SEQ ID NO: 1137 - DNA, 77 bp, Xanthomonas oryzae pv. oryzae KACC10331
  misc_feature (1)..(77): AE013598.1/2682944-2683020 Xanthomonas oryzae pv. oryzae KACC10331, complete genome
tcgggattcggagatggcgttcctccgcgcagttccatcaaaccgtagcgattgctactgatgacgcctacaagaac

SEQ ID NO: 1138 - DNA, 65 bp, Gemmatimonadetes bacterium
  misc_feature (1)..(65): MNFG01000237.1/15519-15455 Gemmatimonadetes bacterium 13_1_40CM_4_69_8 13_1_40cm_4_scaffold_11475, whole genome shotgun sequence
ctttggccaggcgatggagttcgcctcgaaccgccggtgcgccggctgataactcctacccgaac

SEQ ID NO: 1139 - DNA, 66 bp, Anditalea andensis strain LY1
  misc_feature (1)..(66): JMIH01000028.1/181850-181915 Anditalea andensis strain LY1 Contig_28, whole genome shotgun sequence
atcattataggtgatggggttccacctttaaccgcgcaaacagctgctgatgactcctacttcaac

SEQ ID NO: 1140 - DNA, 67 bp, Chitinophaga niabensis strain DSM 24787
  misc_feature (1)..(67): FSRA01000001.1/1529604-1529670 Chitinophaga niabensis strain DSM 24787 genome assembly, contig: Ga0070009_11
cctcaaacaggaaatggtgtcttcctgacccaaccgcttctccgaagctaatggcgcctacaaatta

SEQ ID NO: 1141 - DNA, 76 bp, Ruminococcus sp. CAG:403
  misc_feature (1)..(76): FR899086.1/37911-37836 Ruminococcus sp. CAG:403 genomic scaffold, scf93
ttgattattgggaatgaatgtctcccacggaatcactccgaaaccgcttttctaagctgatgacttctgtttgcat

SEQ ID NO: 1142 - DNA, 75 bp, Citrobacter koseri ATCC BAA-895
  misc_feature (1)..(75): CP000822.1/1490183-1490109 Citrobacter koseri ATCC BAA-895, complete genome
agttcacaaggtgatggtgttccacctttcccaaccgccggttcgctcgaatcggatgatgacgcctgatataca

SEQ ID NO: 1143 - DNA, 68 bp, Enterococcus phoeniculicola ATCC BAA-412
  misc_feature (1)..(68): KB946329.1/254744-254677 Enterococcus phoeniculicola ATCC BAA-412 genomic scaffold acvKl-supercont1.7, whole genome shotgun sequence
cgaataataggtgatggtgttcacctttaaccatttatcacagataaattaatgacgcctactaaaag

SEQ ID NO: 1144 - DNA, 70 bp, Mycobacterium abscessus strain PAP053; identical to SEQ ID NO: 917
  misc_feature (1)..(70): CSXB01000035.1/2984-3053 Mycobacterium abscessus strain PAP053 genome assembly, contig: ERS075544SCcontig000035

SEQ ID NO: 1145 - DNA, 73 bp, Youngiibacter fragilis 232.1
  misc_feature (1)..(73): AXUN02000005.1/18307-18235 Youngiibacter fragilis 232.1 contig_102, whole genome shotgun sequence
tttctacatgggaatgaacgtctcccttggctttgccagaaccgcattttatgctgatgacttctgcgatctc

SEQ ID NO: 1146 - DNA, 84 bp, Aerococcus sanguinicola strain CCUG43001
  misc_feature (1)..(84): CP014160.1/937362-937445 Aerococcus sanguinicola strain CCUG43001, complete genome
caagacacaggaaatgaatgtcttccttgggcctagccctaaaccgctattgatgattcaaaagctgatgacttctgctgtaaa

SEQ ID NO: 1147 - DNA, 73 bp, Erysipelothrix larvae strain LV19 chromosome
  misc_feature (1)..(73): CP013213.1/467579-467651 Erysipelothrix larvae strain LV19 chromosome, complete genome
gtacacaaagggaatgaagttctccctgttctgattaagacaaaccgcatatgctgatgacttctatactttt

SEQ ID NO: 1148 - DNA, 63 bp, Gemmatimonadetes bacterium GWC2_71_10
  misc_feature (1)..(63): MGZC01000119.1/11088-11150 Gemmatimonadetes bacterium GWC2_71_10 gwc2_scaffold_28429, whole genome shotgun sequence
tcagtgatgggtgatggggctcaccccgaaccgccggcgacggctgatggctcctgcgcaaca

SEQ ID NO: 1149 - DNA, 76 bp, Firmicutes bacterium CAG:56
  misc_feature (1)..(76): FR880482.1/2074-1999 Firmicutes bacterium CAG:56 genomic scaffold, scf405
atgactgccgggaatgaggttctccctggtttttaaccaaaccgcttgtatataagctgatgacttctgcgatttc

SEQ ID NO: 1150 - DNA, 68 bp, Flavobacterium akiainvivens strain IK-1
  misc_feature (1)..(68): LIYD01000005.1/2797649-2797582 Flavobacterium akiainvivens strain IK-1 scaffold00001, whole genome shotgun sequence
aagacaaaaggaaatggtgttcttccttacccaaccgctttttaagagctgatgacgcctgattaaac

SEQ ID NO: 1151 - DNA, 82 bp, Mycobacterium sherrisii strain BC1_M4
  misc_feature (1)..(82): MIHC01000025.1/40346-40427 Mycobacterium sherrisii strain BC1_M4 PROKKA_contig000025, whole genome shotgun sequence
gtaactatcggcgatggatgtccgcctgggtgaacactcgtccgaaccgcctcgtatcgaggctgatggctcctgctgcatt

SEQ ID NO: 1152 - DNA, 73 bp, Microlunatus phosphovorus NM-1
  misc_feature (1)..(73): AP012204.1/145014-145086 Microlunatus phosphovorus NM-1 DNA, complete genome
ggtagccgtggcgatggtgtccgcctgaggatcgtcctcgaaccgccggccggctgatgacccctgcgacgaa

SEQ ID NO: 1153 - DNA, 94 bp, Spirochaetes bacterium GWC1_61_12
  misc_feature (1)..(94): MIAU01000034.1/7562-7469 Spirochaetes bacterium GWC1_61_12 gwc1_scaffold_1929, whole genome shotgun sequence
tcggcccacggcgatggagttcgccgagccttcccgattccgggtgaactaaactgcctaccctccggtactggctgatgactcctgccaacat

SEQ ID NO: 1154 - DNA, 62 bp, Rhodospirillales bacterium 70-18; identical to SEQ ID NO: 544
  misc_feature (1)..(62): MKWE01000021.1/65340-65401 Rhodospirillales bacterium 70-18 SCNpilot_cont_750_bf_scaffold_241, whole genome shotgun sequence

SEQ ID NO: 1155 - DNA, 63 bp, Clostridium magnum DSM 2767
  misc_feature (1)..(63): LWAE01000004.1/73755-73693 Clostridium magnum DSM 2767 CLMAG_contig000004, whole genome shotgun sequence
taataattaggtgatgaagttcgcctttaaatatcctttgggattgatggcttctactatatg

SEQ ID NO: 1156 - DNA, 59 bp, Acetobacterium woodii DSM 1030
  misc_feature (1)..(59): CP002987.1/3185660-3185718 Acetobacterium woodii DSM 1030, complete genome
aattaagaaggtgatggagttcacctgaatcacttttagttaatgactcctgtagaatt

SEQ ID NO: 1157 - DNA, 70 bp, Bifidobacterium longum NCC2705
  misc_feature (1)..(70): AE014295.3/925740-925809 Bifidobacterium longum NCC2705, complete genome
tggagaaccggcgatggaacccgcctgaactcgtttcgaaccgcacactgctgatagttcctacacacga

SEQ ID NO: 1158 - DNA, 85 bp, Gluconobacter oxydans H24
  misc_feature (1)..(85): CP003926.1/1810121-1810037 Gluconobacter oxydans H24, complete genome
atttaggaaggcaatggactctgcctgatggcctactggcgatcgaaccgcttccgcgacggaggctgatgattcctacccgacg

SEQ ID NO: 1159 - DNA, 83 bp, Streptomyces rubidus strain CGMCC 4.2026
  misc_feature (1)..(83): FODD01000012.1/10355-10437 Streptomyces rubidus strain CGMCC 4.2026 genome assembly, contig: Ga0079901_1012
tcacgaactggcgatggaccccgccagggacggcgcgatgccgccccgaaccgcccctccgggctgatggctcctgaccgagt

SEQ ID NO: 1160 - DNA, 68 bp, Candidimonas bauzanensis strain CGMCC 1.10190; identical to SEQ ID NO: 1044
  misc_feature (1)..(68): FQXE01000008.1/8132-8065 Candidimonas bauzanensis strain CGMCC 1.10190 genome assembly, contig: Ga0070552_108

SEQ ID NO: 1161 - DNA, 68 bp, Enterococcus villorum ATCC 700913
  misc_feature (1)..(68): KB946287.1/569530-569463 Enterococcus villorum ATCC 700913 genomic scaffold acvIF-supercont1.8, whole genome shotgun sequence
aagtgaataggtgatggtgttcgcctttaaacgttattctttagataactaatgacgcctactaaaaa

SEQ ID NO: 1162 - DNA, 63 bp, Burkholderia fungorum strain ATCC BAA-463 chromosome 1
  misc_feature (1)..(63): CP010026.1/62545-62607 Burkholderia fungorum strain ATCC BAA-463 chromosome 1, complete sequence
ttgcgcgctggagatggcattctccattaaccgcccttgatggctgatgatgcctgcttcgcc

SEQ ID NO: 1163 - DNA, 73 bp, Acidobacteria bacterium
  misc_feature (1)..(73): MNDE01000149.1/15745-15673 Acidobacteria bacterium 13_2_20CM_57_17 13_2_20cm_scaffold_1184, whole genome shotgun sequence
atttcggaaggcgatggagttcgccataaccgtcccggcactgttcaccgggtctgatgactcctggcagacg

SEQ ID NO: 1164 - DNA, 83 bp, Chloroflexi bacterium
  misc_feature (1)..(83): MGNH01000132.1/8045-7963 Chloroflexi bacterium RBG_16_48_7 RBG_16_scaffold_64961, whole genome shotgun sequence
tttatctagggcgatgaagctcgccgaggaagttcggaactttcctgaactgctttgagaaagctaatagcttctaccggtat

SEQ ID NO: 1165 - DNA, 78 bp, Bradyrhizobium sp. S23321
  misc_feature (1)..(78): AP012279.1/5492285-5492362 Bradyrhizobium sp. S23321 DNA, complete genome
cgcacagatggggatggagtcccccgataaccgcccgacggcccgtgaccgtactgggctgatgactcctgctcgagg

SEQ ID NO: 1166 - DNA, 63 bp, Acidiphilium rubrum strain ATCC 35905
  misc_feature (1)..(63): FTNE01000002.1/116552-116490 Acidiphilium rubrum strain ATCC 35905 genome assembly, contig: Ga0104712_102
tctgcctgcggcgatggagttcgccatgtaaccgcccgcggggctgatgactcctgttccttg

SEQ ID NO: 1167 - DNA, 82 bp, Clostridium hathewayi CAG:224
  misc_feature (1)..(82): HF996938.1/32238-32157 Clostridium hathewayi CAG:224 genomic scaffold, scf126
ctataccccgggaatgaggtctcccgtggtagtgaacatgttaccagaaccgcttattacagctgatggcttctgcattgtg

SEQ ID NO: 1168 - DNA, 62 bp, Desulfovibrio mexicanus strain DSM 13116
  misc_feature (1)..(62): FZOC01000008.1/25292-25353 Desulfovibrio mexicanus strain DSM 13116 genome assembly, contig: Ga0070557_108
atgaccagaggggatggagttccccttgaaccgcgacagacgctgatgactcctgctgcccg

SEQ ID NO: 1169 - DNA, 85 bp, Acidomonas methanolica NBRC 104435 DNA
  misc_feature (1)..(85): BAND01000009.1/9337-9253 Acidomonas methanolica NBRC 104435 DNA, contig: Amme_009
attcagcaaggcaatggattctgcctgatggcctgatggcgatcgaaccgcttccgcgacggaggctgatgattcctacccgacg

SEQ ID NO: 1170 - DNA, 75 bp, Betaproteobacteria bacterium RIFCSPLOWO2_12_FULL_62_58
  misc_feature (1)..(75): MERI01000159.1/4172-4246 Betaproteobacteria bacterium RIFCSPLOWO2_12_FULL_62_58 rifcsplowo2_12_scaffold_32846, whole genome shotgun sequence
ccagcacaaggagatggcattcctcctttaagctccaacaaaaccgcctgtcaggctgatgatgcctacggtttt

SEQ ID NO: 1171 - DNA, 78 bp, Roseateles depolymerans strain KCTC 42856
  misc_feature (1)..(78): CP013729.1/208392-208469 Roseateles depolymerans strain KCTC 42856, complete genome
tcgccgcacggagatggcattcctccgcgaaccgccgaacgacgccctcgtcgtgacgctgatgatgcctacatcgtc

SEQ ID NO: 1172 - DNA, 75 bp, Clostridium lentocellum DSM 5427
  misc_feature (1)..(75): CP002582.1/2204933-2205007 Clostridium lentocellum DSM 5427, complete genome
ataaataaggggaatgaagtactccctaagtttgatacttaaaccgcttataaagctgatgacttctgtgaaaca

SEQ ID NO: 1173 - DNA, 62 bp, Burkholderia xenovorans LB400 chromosome 1
  misc_feature (1)..(62): CP000270.1/1757402-1757341 Burkholderia xenovorans LB400 chromosome 1, complete sequence
tgctgcgctggagatggcattctcctttaaccgcccttatggctgatgatgcctgctcgccc

SEQ ID NO: 1174 - DNA, 70 bp, Pantoea vagans C9-1; identical to SEQ ID NO: 639
  misc_feature (1)..(70): CP002206.1/1030223-1030154 Pantoea vagans C9-1, complete genome

SEQ ID NO: 1175 - DNA, 81 bp, Kushneria sp. YCWA18
  misc_feature (1)..(81): MKZT01000024.1/330276-330356 Kushneria sp. YCWA18 contig24, whole genome shotgun sequence
attgataagggagatggcatgcctcccgaatgcgcccgtattcaaaccatcacgtccgtgattgatgatgcctgcagtacg

SEQ ID NO: 1176 - DNA, 68 bp, Arachidicoccus sp. BS20
  misc_feature (1)..(68): CP015971.1/1426412-1426479 Arachidicoccus sp. BS20, complete genome
ttaaaaaaaggtaatggcattctaccttatcaaccgcctttaagaaggacgatgatgcctgtaaaaat

SEQ ID NO: 1177 - DNA, 67 bp, Sinomicrobium oceani strain CGMCC 1.12145
  misc_feature (1)..(67): FPJE01000012.1/99004-98938 Sinomicrobium oceani strain CGMCC 1.12145 genome assembly, contig: IQ32DRAFT_scaffold00012.12
aaaatcagtggcaatggtgtctgccctgaaccgcccttttacaagggataatggcgcctgttatcgt

SEQ ID NO: 1178 - DNA, 68 bp, Elusimicrobia bacterium RIFCSPLOWO2_12_FULL_59_9
  misc_feature (1)..(68): MGUX01000142.1/8815-8748 Elusimicrobia bacterium RIFCSPLOWO2_12_FULL_59_9 rifcsplowo2_12_scaffold_6648, whole genome shotgun sequence
tcgaaaaaaggcgatggagttcgcctaaaccgccccggaagcccggggatgatgactcctgccgacgc

SEQ ID NO: 1179 - DNA, 73 bp, Citrobacter koseri ATCC BAA-895
  misc_feature (1)..(73): CP000822.1/1409469-1409541 Citrobacter koseri ATCC BAA-895, complete genome
cctgtgcagggtgatggcgttccaccttattccaaccgcctcgtttcagtaggctgatgacgcctgatatgac

SEQ ID NO: 1180 - DNA, 69 bp, Candidatus Rokubacteria bacterium; identical to SEQ ID NO: 1005
  misc_feature (1)..(69): MNJV01000118.1/2962-2894 Candidatus Rokubacteria bacterium 13_1_20CM_2_70_7 13_1_20cm_2_scaffold_3979, whole genome shotgun sequence

SEQ ID NO: 1181 - DNA, 60 bp, Desulfovibrio sp. 6_1_46AFAA
  misc_feature (1)..(60): JH114303.1/129496-129555 Desulfovibrio sp. 6_1_46AFAA genomic scaffold supercont1.4, whole genome shotgun sequence
cagggcaacggggatggggtcccccataaaaccgcattcgttgatgactcctgccagcgc

SEQ ID NO: 1182 - DNA, 60 bp, Bacillus anthracis str. 'Ames Ancestor'
  misc_feature (1)..(60): AE017334.2/4823859-4823918 Bacillus anthracis str. 'Ames Ancestor', complete genome
ataatcataggcgatggagttcgccataaacgctgcttagctaatgactcctaccagtat

SEQ ID NO: 1183 - DNA, 74 bp, Clostridium sp. FS41
  misc_feature (1)..(74): JYHN01000069.1/66814-66741 Clostridium sp. FS41 CLFS41_contig000076, whole genome shotgun sequence
cgtgagtatgggaatgaggttctcccttagtgaatactaaaaccgcttatcaagctgatgacttctgcgtaaat

SEQ ID NO: 1184 - DNA, 72 bp, Clostridium sp. D5
  misc_feature (1)..(72): GL870809.1/1469640-1469711 Clostridium sp. D5 genomic scaffold supercont1.1, whole genome shotgun sequence
agattttaagggaatgaggttctcccgtggagtattccaaaagcgcattttgctgatgacttctgtgtaaaa

SEQ ID NO: 1185 - DNA, 66 bp, Vibrio fischeri ES114 chromosome II
  misc_feature (1)..(66): CP000021.2/1258800-1258735 Vibrio fischeri ES114 chromosome II, complete sequence
atacgtaaaggtgatggggttccacctacttaaccgccaatgttggctgatgactcctacagaata

SEQ ID NO: 1186 - DNA, 80 bp, Methylacidiphilum fumariolicum SolV, WGS project CAHT01000000 data
  misc_feature (1)..(80): CAHT01000010.1/3917-3838 Methylacidiphilum fumariolicum SolV, WGS project CAHT01000000 data, contig: 90-2114
aaagcaattggtaatggagtttaccatccaatcttttggaaaacccttcttctttaagaagtgataactcctacgacaac

SEQ ID NO: 1187 - DNA, 67 bp, Enterococcus faecium DO
  misc_feature (1)..(67): CP003583.1/1868350-1868284 Enterococcus faecium DO, complete genome
aagtgaataggtgatggtgttcgcctttaaatgctaacgaaagatagctaatgacgcctactaaagt

SEQ ID NO: 1188 - DNA, 86 bp, Clostridium proteolyticum DSM 3090
  misc_feature (1)..(86): FRAD01000003.1/165246-165161 Clostridium proteolyticum DSM 3090 genome assembly, contig: EJ39DRAFT_scaffold00001.1
aaaagataagggaatgaagttctccctagtataatactgttgtattatatttaaaccgcatttatgctgatgacttctgctattat

SEQ ID NO: 1189 - DNA, 75 bp, Xanthomonadales bacterium 63-13
  misc_feature (1)..(75): MKWR01000013.1/156999-156925 Xanthomonadales bacterium 63-13 scnpilot_p_inoc_scaffold_240, whole genome shotgun sequence
cccgtccgcggagatggcattcctccggccccattcgggcaaaccgccgcctcggctgatgatgcctgccccacc

SEQ ID NO: 1190 - DNA, 74 bp, Acidomonas methanolica NBRC 104435
  misc_feature (1)..(74): BAND01000009.1/12015-11942 Acidomonas methanolica NBRC 104435 DNA, contig: Amme_009
atcaacgaaggcaatggactctgcctggccgccgtggccgaaccgcccccagggctgatgactcctacctcgcc

SEQ ID NO: 1191 - DNA, 136 bp, Chromohalobacter salexigens DSM 3043
  misc_feature (1)..(136): CP000285.1/2902118-2902253 Chromohalobacter salexigens DSM 3043, complete genome
gtggatgccggagatggcattcctccggtcgccgagccccgtcatgtgcggtgccaccgcgacaaaccgcctggcgtgatccgagaccatgacgtctcgaccaccggccgccagcgctaatgatgcctgccaacgc

SEQ ID NO: 1192 - DNA, 69 bp, Bacteroides plebeius CAG:211
  misc_feature (1)..(69): HF998200.1/85537-85605 Bacteroides plebeius CAG:211 genomic scaffold, scf611
tcgaatcaagggaatgggacttccctgtgataaaccgctaatgaagtagctgatagttcctaccggagc

SEQ ID NO: 1193 - DNA, 65 bp, Candidatus Burkholderia humilis strain UZHbot5 BHUMctg14
  misc_feature (1)..(65): LFMX01000014.1/29847-29783 Candidatus Burkholderia humilis strain UZHbot5 BHUMctg14, whole genome shotgun sequence
tttgacataggagatggcattctccttcaaccgctcgccctcgagccgatgatgcctaccccgcg

SEQ ID NO: 1194 - DNA, 77 bp, Gordonibacter pamelaeae 7-10-1-b
  misc_feature (1)..(77): FP929047.1/1868297-1868221 Gordonibacter pamelaeae 7-10-1-b draft genome
aatgcctgcgggaatgaggttctccctaagccgtttcaaggcttgaaccgcgtaaagctgatgacttctgcaaacgg

SEQ ID NO: 1195 - DNA, 83 bp, Syntrophobacteraceae bacterium
  misc_feature (1)..(83): MNZR01000173.1/200-282 Syntrophobacteraceae bacterium CG2_30_61_12 cg2_3.0_scaffold_29238_c, whole genome shotgun sequence
catgcgacaggcaatgaagtctgcctgaaaccgcccggctctgcccgcgagccgcctgcagggctgatgacttctacctcgtt

SEQ ID NO: 1196 - DNA, 62 bp, Mycobacterium sherrisii strain BC1_M4
  misc_feature (1)..(62): MIHC01000025.1/17004-17065 Mycobacterium sherrisii strain BC1_M4 PROKKA_contig000025, whole genome shotgun sequence
attgacccaggcgatgaagctcgcctcaaccgccgcacccggctaatggcttctaccgcgcg

SEQ ID NO: 1197 - DNA, 74 bp, Sphingomonas sp. MM-1
  misc_feature (1)..(74): CP004036.1/3514107-3514034 Sphingomonas sp. MM-1, complete genome
gtcggcaacggcaatggattcctgccgggcctcgcgccgaaccgccattgagggctgatgattcctacctgcgg

SEQ ID NO: 1198 - DNA, 61 bp, Thermanaerothrix daxensis strain GNS-1
  misc_feature (1)..(61): LGKO01000002.1/1173186-1173246 Thermanaerothrix daxensis strain GNS-1 contig_1, whole genome shotgun sequence
atacttggtggcgatgaggctcgccgtaagtgtcggtatgactaatagcctctacttgaac

SEQ ID NO: 1199 - DNA, 62 bp, Deltaproteobacteria bacterium RBG_13_51_10
  misc_feature (1)..(62): MGQE01000007.1/105-44 Deltaproteobacteria bacterium RBG_13_51_10 RBG_13_scaffold_11549_curated, whole genome shotgun sequence
atttattacggtgatggagtccaccgaagagtgcctcaaaggctgatgactcctaccaaggt

SEQ ID NO: 1200 - DNA, 61 bp, Bacteroidetes bacterium GWE2_42_42
  misc_feature (1)..(61): MEOC01000004.1/19599-19659 Bacteroidetes bacterium GWE2_42_42 gwe2_scaffold_115, whole genome shotgun sequence
tatttttcgggcgatgaggttcgccctgaaccgccgaaaggctgatgacctctgcagataa

SEQ ID NO: 1201 - DNA, 60 bp, Nitrobacter sp. 62-23
  misc_feature (1)..(60): MKSM01000141.1/6408-6349 Nitrobacter sp. 62-23 SCNpilot_cont_300_bf_scaffold_967, whole genome shotgun sequence
gaccaagatggggatggagtcccccgaaaccgccgcaaggctgatgactcctgccgcgcg

SEQ ID NO: 1202 - DNA, 66 bp, Caldibacillus debilis strain B4135
  misc_feature (1)..(66): LQYT01000056.1/35438-35503 Caldibacillus debilis strain B4135 NODE_72, whole genome shotgun sequence
ttatcatccggtgatggagttccgccgttaacctccttgcaaaaggctgatgactcctgctgaaaa

SEQ ID NO: 1203 - DNA, 65 bp, Solirubrobacterales bacterium 70-9
  misc_feature (1)..(65): MKSH01000031.1/2971-2907 Solirubrobacterales bacterium 70-9 SCNpilot_bf_inoc_scaffold_1372, whole genome shotgun sequence
cctgttccgagcgatggggctcgctccataaccgcggcgcgaccgttgatggctcctaccgacgt

SEQ ID NO: 1204 - DNA, 76 bp, Palaeococcus pacificus DY20341
  misc_feature (1)..(76): CP006019.1/502086-502161 Palaeococcus pacificus DY20341, complete genome
cctaagctgggcgatggcgtccgcctgggcttcgagcccaaaccgcccgcaatgggctaatgacgcctgttctcac

SEQ ID NO: 1205 - DNA, 63 bp, Geosporobacter ferrireducens strain IRF9
  misc_feature (1)..(63): CP017269.1/1004610-1004672 Geosporobacter ferrireducens strain IRF9, complete genome
atttcaataggtgatggggctcaccactaatattgcttagcaattgatggctcctactaaagt

SEQ ID NO: 1206 - DNA, 63 bp, Desulfomonile tiedjei DSM 6799
  misc_feature (1)..(63): CP003360.1/2604039-2603977 Desulfomonile tiedjei DSM 6799, complete genome
acagatgacggggatggagtccccccaaaatgctcgtaatgagctgatgactcctaccgctac

SEQ ID NO: 1207 - DNA, 72 bp, Cupriavidus sp. USMAA2-4 chromosome 2
  misc_feature (1)..(72): CP017749.1/2273623-2273694 Cupriavidus sp. USMAA2-4 chromosome 2, complete sequence
gcatcacgcggagatggcattcctcctctaaccgccgtcgttttatatgcggctgatgatgcctacaggtcc

SEQ ID NO: 1208 - DNA, 71 bp, Acetobacterium woodii DSM 1030
  misc_feature (1)..(71): CP002987.1/1840156-1840226 Acetobacterium woodii DSM 1030, complete genome
ctatataaaggggatgaagttcgccttggccaatgccaaaatgctgataagctgatgacttctgcaaatag

SEQ ID NO: 1209 - DNA, 60 bp, Methylocystis sp. strain SC2 plasmid 2
  misc_feature (1)..(60): FO000002.1/10207-10266 Methylocystis sp. strain SC2 plasmid 2
ccttgtcccggcgatagagttcgcgctcaaccgcctgcggctgatgacccctgctctaca

SEQ ID NO: 1210 - DNA, 64 bp, Pediococcus stilesii strain DSM 18001
  misc_feature (1)..(64): JQBX01000016.1/12805-12868 Pediococcus stilesii strain DSM 18001 Scaffold16, whole genome shotgun sequence
aattgaataggcgatgacgttcgccgtaaataattgataataatttgatgacgtctattacttt

SEQ ID NO: 1211 - DNA, 73 bp, Candidatus Bathyarchaeota archaeon
  misc_feature (1)..(73): MEZF01000053.1/3627-3699 Candidatus Bathyarchaeota archaeon RBG_13_52_12 RBG_13_scaffold_25772, whole genome shotgun sequence
atgtttttcggcgatgaagtccgcctaagctgtcgcttaaaccgcccgtggggctgatgacctctacaaccca

SEQ ID NO: 1212 - DNA, 60 bp, Bacillus cereus subsp. cytotoxis NVH 391-98
  misc_feature (1)..(60): CP000764.1/3708919-3708978 Bacillus cereus subsp. cytotoxis NVH 391-98, complete genome
aatgaatacggcgatggagttcgccacaaccgctgcttagctaatgactcctaccaggat

SEQ ID NO: 1213 - DNA, 73 bp, Enterococcus sp. 8G7_MSG3316
  misc_feature (1)..(73): NGKU01000001.1/2071454-2071526 Enterococcus sp. 8G7_MSG3316 scaffold00001, whole genome shotgun sequence
ctcgacaaaggaaatgaatgtcttcctcagttttgactgaaaccgcaaatttgctaatgacttctaccactta

SEQ ID NO: 1214 - DNA, 67 bp, Mucilaginibacter polytrichastri strain RG4-7
  misc_feature (1)..(67): MPPL01000001.1/5613334-5613400 Mucilaginibacter polytrichastri strain RG4-7 Scaffold1, whole genome shotgun sequence
gtactgaaaggcaatggtgagctgcctatttgaaccgccttaaaaagctgatgacgcctactcgaat

SEQ ID NO: 1215 - DNA, 73 bp, Eubacterium sp. CAG:192
  misc_feature (1)..(73): FR883297.1/5583-5511 Eubacterium sp. CAG:192 genomic scaffold, scf283
ttaaataaagggaatgaggttctcccttgattttatcaaaaccgctagtaaagctgatgacttctgtgtaaca

SEQ ID NO: 1216 - DNA, 60 bp, Methanospirillum hungatei JF-1
  misc_feature (1)..(60): CP000254.1/1236994-1237053 Methanospirillum hungatei JF-1, complete genome
aatcctgccggtgatgagatccaccgtaaaccgcccgctgctaatgacttctacccggaa

SEQ ID NO: 1217 - DNA, 69 bp, Candidimonas bauzanensis strain CGMCC 1.10190
  misc_feature (1)..(69): FQXE01000023.1/21421-21489 Candidimonas bauzanensis strain CGMCC 1.10190 genome assembly, contig: Ga0070552_123
ttcagatacggagatggcatacctcctatcccaaccgctggattcccagctgatgatgcctacgaattt

SEQ ID NO: 1218 - DNA, 62 bp, Clostridium sp. JC272
  misc_feature (1)..(62): LBBT01000022.1/3006-3067 Clostridium sp. JC272 Contig23, whole genome shotgun sequence
aattaaatcggcgatggagttcgccattaaatgcataagatgctaatgactcctactcttat

SEQ ID NO: 1219 - DNA, 62 bp, Candidatus Colwellbacteria bacterium
  misc_feature (1)..(62): MHIY01000004.1/11965-12026 Candidatus Colwellbacteria bacterium RIFCSPLOWO2_01_FULL_48_10 rifcsplowo2_01_scaffold_11379, whole genome shotgun sequence
agttacaatggcgatggagttcgccaaaaccgccttcacaggctgatgactcctgccaatta

SEQ ID NO: 1220 - DNA, 58 bp, Erysipelothrix rhusiopathiae str. Fujisawa
  misc_feature (1)..(58): AP012027.1/1689511-1689454 Erysipelothrix rhusiopathiae str. Fujisawa DNA, complete genome
ttacaaaacggtgatggggtttgtcataactgcgacagctgataactcctacataaga

SEQ ID NO: 1221 - DNA, 68 bp, Chryseobacterium gallinarum strain DSM 27622
  misc_feature (1)..(68): CP009928.1/3333143-3333076 Chryseobacterium gallinarum strain DSM 27622, complete genome
gtatcaaaaggaaatggtgttcttccttacccaaccgctttacagaagctgatgacgcctgattgaga

SEQ ID NO: 1222 - DNA, 69 bp, Halogeometricum pallidum JCM 14848
  misc_feature (1)..(69): AOIV01000036.1/89301-89233 Halogeometricum pallidum JCM 14848 contig_36, whole genome shotgun sequence
ggtagaacaggcgatggagtccgcctaatccaaccgccgaatccgtcggctgatgactcctgtctatga

SEQ ID NO: 1223 - DNA, 74 bp, Coprobacillus sp. 29_1
  misc_feature (1)..(74): GL636579.1/244140-244213 Coprobacillus sp. 29_1 genomic scaffold supercont1.3, whole genome shotgun sequence
ctatagcaagggaatgaatgtctcccttagtttaagaactaaaaccgctacatgctgatgacttctgcattttt

SEQ ID NO: 1224 - DNA, 65 bp, Betaproteobacteria bacterium
  misc_feature (1)..(65): MEQZ01000078.1/2332-2268 Betaproteobacteria bacterium RIFCSPLOWO2_02_FULL_65_20 rifcsplowo2_02_scaffold_18574, whole genome shotgun sequence
attctgccgggagatggcattcctcctttaaccgccgcgcgccggctaatgatgcctacacggaa

SEQ ID NO: 1225 - DNA, 72 bp, Shimwellia blattae DSM 4481
  misc_feature (1)..(72): CP001560.1/792938-792867 Shimwellia blattae DSM 4481 = NBRC 105725, complete genome
attccgggcggagatggcattcctcccgtgtaacaaaccgcctttgcgaaggctgatgatgcctgcatgatt

SEQ ID NO: 1226 - DNA, 61 bp, Nitrobacter winogradskyi Nb-255
  misc_feature (1)..(61): CP000115.1/166253-166313 Nitrobacter winogradskyi Nb-255, complete genome
gaaatcgatggggatggagtcccccgataaccgccgcaaggctgatgactcctaccgggcg

SEQ ID NO: 1227 - DNA, 75 bp, Fischerella sp. JSC-11
  misc_feature (1)..(75): AGIZ01000001.1/281997-282071 Fischerella sp. JSC-11 ctg118, whole genome shotgun sequence
gatgttaaaggtgatgaaactcaccttctggcatttccagagaaccgccactcggctaatagtttctagctcaac

SEQ ID NO: 1228 - DNA, 64 bp, Achromobacter insuavis
  misc_feature (1)..(64): GL982453.1/6334526-6334589 Achromobacter insuavis AXX-A genomic scaffold scaffold00003, whole genome shotgun sequence
aacgcaaatgggaatggagcttcccaaaaccgccgatccgtcggctgatggctcctgctgatcc

SEQ ID NO: 1229 - DNA, 94 bp, Nitrospirae bacterium
  misc_feature (1)..(94): MHEE01000007.1/18381-18474 Nitrospirae bacterium GWF2_44_13 gwf2_scaffold_206, whole genome shotgun sequence
tttagtatcggcgatggagttcgccattaactccgttaaaaaatacggagtaaaccgtcccgatcttatcggaactgatgactcctactctcac

SEQ ID NO: 1230 - DNA, 59 bp, Turicibacter sanguinis PC909
  misc_feature (1)..(59): ADMN01000037.1/24546-24488 Turicibacter sanguinis PC909 contig00012, whole genome shotgun sequence
ttatcaataggcgatggagttcgccattaaccgcgtaagctaatgactcctactcttta

SEQ ID NO: 1231 - DNA, 106 bp, Synechococcus sp. JA-2
  misc_feature (1)..(106): CP000240.1/171311-171206 Synechococcus sp. JA-2-3B'a(2-13), complete genome
ccggcaaccggcgatggagttcgccgcaaccgcctcacttggaatttttctatagaggaagagggttctaacctcaaaagctgaggctgatgactcctacacttct

SEQ ID NO: 1232 - DNA, 74 bp, Friedmanniella sagamiharensis strain DSM 21743
  misc_feature (1)..(74): LT629799.1/1480323-1480250 Friedmanniella sagamiharensis strain DSM 21743 genome assembly, chromosome
ttgtcccctggcgatggattccgccggaggtcgcgacctcgaaccgccgcacggctgatgactcctggacgctc

SEQ ID NO: 1233 - DNA, 60 bp, Rhizobiales bacterium 65-79 SCN
  misc_feature (1)..(60): MKRJ01000017.1/40298-40357 Rhizobiales bacterium 65-79 SCNpilot_cont_1000_bf_scaffold_222, whole genome shotgun sequence
tatccaacagggaatggagtctcccttcaaccgccgtcggctgatgactcctgctgcgta

SEQ ID NO: 1234 - DNA, 73 bp, Deltaproteobacteria bacterium
  misc_feature (1)..(73): MGRA01000126.1/7736-7664 Deltaproteobacteria bacterium RBG_19FT_COMBO_46_12 rbg_19ft_combo_scaffold_1869, whole genome shotgun sequence
atcaatctcggtgatgaagttcgccattaaccgctccccccttttatcgggggctgataacttctactagttt

SEQ ID NO: 1235 - DNA, 63 bp, Sphingobacterium sp. Ag1
  misc_feature (1)..(63): LBGU01000041.1/56834-56772 Sphingobacterium sp. Ag1 JX05_contig_20, whole genome shotgun sequence
aatagatatggcaatgatgtctgcccttaaccgccttaataagctgatgacgtctactatttt

SEQ ID NO: 1236 - DNA, 77 bp, Sphingomonas sp.
  misc_feature (1)..(77): LMLS01000005.1/17281-17205 Sphingomonas sp. Leaf231 contig_5, whole genome shotgun sequence
gctcggcacggcgatggatttccgccgggccattcggccgaaccgccctcgcaagggtcgatgattcctaccaggcg

SEQ ID NO: 1237 - DNA, 74 bp, Cellulosimicrobium funkei strain U11
  misc_feature (1)..(74): JNBQ01000001.1/173215-173288 Cellulosimicrobium funkei strain U11 contig00001, whole genome shotgun sequence
gctgagggcggtgatggatcccgccagggctagccgcccgaaccgccgccagggctgatggttcctgtctcgtc

SEQ ID NO: 1238 - DNA, 73 bp, Burkholderiales bacterium
  misc_feature (1)..(73): MESK01000107.1/33086-33014 Burkholderiales bacterium RIFCSPLOWO2_12_FULL_64_99 rifcsplowo2_12_scaffold_76, whole genome shotgun sequence
ccacacgtgggagatggcatgcctccctgaaccgccccgatccccttcgggcgctgatgatgcctacagaagt

SEQ ID NO: 1239 - DNA, 64 bp, Clostridium aceticum strain DSM 1496
  misc_feature (1)..(64): CP009687.1/513822-513885 Clostridium aceticum strain DSM 1496, complete genome
taattaaatggcgatggagttcgcccttaaccactgaaatttagttgatgactcctgtaaaaca

SEQ ID NO: 1240 - DNA, 64 bp, Pseudogulbenkiania sp. NH8B
  misc_feature (1)..(64): AP012224.1/865518-865455 Pseudogulbenkiania sp. NH8B DNA, complete genome
tccgcgacaggagatggcatgcctccttgtaaccgccctcggggctgatgatgcctacacggat

SEQ ID NO: 1241 - DNA, 70 bp, Cesiribacter andamanensis AMV16
  misc_feature (1)..(70): AODQ01000006.1/6334-6265 Cesiribacter andamanensis AMV16 contig000006, whole genome shotgun sequence
gcagccataggcaatggtgtctgccttgaaccgcctggatacagctcaggatgatggcgcctgctcccag

SEQ ID NO: 1242 - DNA, 60 bp, Clostridium sp. MSTE9
  misc_feature (1)..(60): AKFU01000006.1/20391-20332 Clostridium sp. MSTE9 ctg120006482988, whole genome shotgun sequence
aatattcaaagtgatgaggctcacttgaattgctgaaaagctgatggcttctaccttaag

SEQ ID NO: 1243 - DNA, 77 bp, Streptomyces nanshensis strain SCSIO
  misc_feature (1)..(77): LJGW01000451.1/16452-16528 Streptomyces nanshensis strain SCSIO 10429 scaffold449, whole genome shotgun sequence
ctgagccgaggcgatggaacccgcccgggccgcttccggcccgaaccgccctccgggctgatggtccctgaccgagg

SEQ ID NO: 1244 - DNA, 62 bp, Alicyclobacillus macrosporangiidus strain DSM
  misc_feature (1)..(62): FPBV01000009.1/77626-77565 Alicyclobacillus macrosporangiidus strain DSM 17980 genome assembly, contig: Ga0104483_109
tggaacatgggtgatggggctcacctaaaccgcctgccaaggctgatggctcctgcgaaccg

SEQ ID NO: 1245 - DNA, 71 bp, Sharpea azabuensis strain DSM 20406
  misc_feature (1)..(71): FNYK01000003.1/65728-65798 Sharpea azabuensis strain DSM 20406 genome assembly, contig: Ga0059086_1003
taagcacaagggaatgaatgtctcccgcgagcaatcgaaaccgctattaagctgatgacttctatcttatt

SEQ ID NO: 1246 - DNA, 66 bp, Spirochaetes bacterium RBG_16_49
  misc_feature (1)..(66): MIBJ01000074.1/1274-1209 Spirochaetes bacterium RBG_16_49_21 RBG_16_scaffold_826, whole genome shotgun sequence
tgttatcaaggggatggagtcccccgtataaatgcacaatgttcggctgatgactcctaccgcatc

SEQ ID NO: 1247 - DNA, 97 bp, Rhodanobacter fulvus Jip2
  misc_feature (1)..(97): AJXU01000007.1/18977-19073 Rhodanobacter fulvus Jip2 contig007, whole genome shotgun sequence
gccgctccgggagatggcatgcctcccgttcccgcgacagggtcgagggaaccaaccgccccgcatcactgcaggggctgatgatgcctgcaccacc

SEQ ID NO: 1248 - DNA, 83 bp, Pedosphaera parvula
  misc_feature (1)..(83): ABOX02000009.1/3464-3546 Pedosphaera parvula Ellin514 ctg190, whole genome shotgun sequence
atatgcattggcaatggggtttgccttctcggtcaacgagagaaccgcctgattatttcggtgctgataactcctattggtac

SEQ ID NO: 1249 - DNA, 76 bp, Vibrio panuliri strain CAIM 703 CAIM703_4
  misc_feature (1)..(76): MJMJ01000034.1/323335-323260 Vibrio panuliri strain CAIM 703 CAIM703_4, whole genome shotgun sequence
tagcgacaaggtgatggggtgccaccggaatcaaaagattcgaaccgcttataaagctgatgactcctacagaaac

SEQ ID NO: 1250 - DNA, 79 bp, Methanobacterium congolense isolate Buetzberg
  misc_feature (1)..(79): LT607756.1/1813946-1813868 Methanobacterium congolense isolate Buetzberg genome assembly, chromosome
ccattaacaggtgatggagttcacctttaattgccaaagatatatcttttatcctttggatgatgactcctaccgtaag

SEQ ID NO: 1251 - DNA, 73 bp, Acidobacteria bacterium
  misc_feature (1)..(73): MNEA01000136.1/8806-8734 Acidobacteria bacterium 13_2_20CM_2_57_6 13_2_20cm_2_scaffold_458, whole genome shotgun sequence
cattctggaggcgatggagttcgccataaccgtcccggcgctgttcaccgggtctgatgactcctggcagcag

SEQ ID NO: 1252 - DNA, 70 bp, Burkholderia sp. STM 7183
  misc_feature (1)..(70): CYGY02000045.1/1800-1869 Burkholderia sp. STM 7183 genome assembly, contig: CYGY01000045
gtgtctgccggagatggcatttctgcctaaccgccgctgctcgtgtgcggctgatgatgcctactgggcc

SEQ ID NO: 1253 - DNA, 66 bp, Mycobacterium heidelbergense strain DSM 44471
  misc_feature (1)..(66): MVHR01000005.1/136280-136345 Mycobacterium heidelbergense strain DSM 44471 NODE_5_length_243907_cov_56.1658, whole genome shotgun sequence
ttcgcggccggcgatgaagctccgccgcctttcgcgccgtccggcgctgatggcttctaccccgca

SEQ ID NO: 1254 - DNA, 81 bp, Anaeromyxobacter sp. RBG_16_69
  misc_feature (1)..(81): MEMX01000112.1/17983-18063 Anaeromyxobacter sp. RBG_16_69_14 RBG_16_scaffold_4847, whole genome shotgun sequence
cgacatcgaggcgatgaagctcgcccgtcgttcgggacgccgccaaccagcccgagaggggttgatagcttctgcgaggcc

SEQ ID NO: 1255 - DNA, 68 bp, Myroides profundi strain D25
  misc_feature (1)..(68): CP010817.1/973882-973815 Myroides profundi strain D25, complete genome
taaatcatgggcaatgatgtctgcctcgaaccgcttctctatagaatgctgatgacgtctaacataat

SEQ ID NO: 1256 - DNA, 77 bp, Novosphingobium sp. AP12 PMI02
  misc_feature (1)..(77): AKKE01000136.1/14252-14328 Novosphingobium sp. AP12 PMI02_contig_294.294, whole genome shotgun sequence
caaggcgacggcgatggatttccgccgggccacttggccgaaccgccctcgcaagggtcgatgattcctaccaggcg

SEQ ID NO: 1257 - DNA, 75 bp, Finegoldia magna ATCC 29328
  misc_feature (1)..(75): AP008971.1/1641037-1640963 Finegoldia magna ATCC 29328 DNA, complete genome
atagatttggggaatgaagtgctcccttgttattaactaaaacgcaaaaattttgctgatgacttctgtttttta

SEQ ID NO: 1258 - DNA, 63 bp, Deltaproteobacteria bacterium 13_1_40CM
  misc_feature (1)..(63): MNFK01000059.1/3686-3748 Deltaproteobacteria bacterium 13_1_40CM_4_54_4 13_1_40cm_4_scaffold_4977, whole genome shotgun sequence
tccattcgcggagatggcgttctcctctaaccgcccaccagggctgatgacgcctacttcaat

SEQ ID NO: 1259 - DNA, 60 bp, Clostridium chromiireducens strain DSM 23318
  misc_feature (1)..(60): MZGT01000023.1/10005-10064 Clostridium chromiireducens strain DSM 23318 CLCHR_contig000023, whole genome shotgun sequence
tatattttaggtgatggagttcgcctttaactgcgtaatgctaatgactcctacaaaata

SEQ ID NO: 1260 - DNA, 60 bp, Desulfotomaculum aeronauticum DSM
  misc_feature (1)..(60): FRAR01000004.1/46252-46311 Desulfotomaculum aeronauticum DSM 10349 genome assembly, contig: EJ44DRAFT_scaffold00001.1
aattaatacggcgatggagttcgccataactgcccttgggctaatgactcctacctaatt

SEQ ID NO: 1261 - DNA, 76 bp, Proteiniclasticum ruminis strain ML2
  misc_feature (1)..(76): FOVK01000003.1/204991-205066 Proteiniclasticum ruminis strain ML2 genome assembly, contig: Ga0073291_103
tagacttctggaaatgaagtgcttccatggcaaaaactgccaaaaccgcaagtatgctgatgacttctacgacgaa

SEQ ID NO: 1262 - DNA, 73 bp, Methanobrevibacter filiformis strain DSM 11501
  misc_feature (1)..(73): LWMT01000242.1/9864-9792 Methanobrevibacter filiformis strain DSM 11501 MBFIL_contig000242, whole genome shotgun sequence
ttaattaaaggtgatgaggttcacctatttaactgccaactttttaaaagtggctgatgacctatataaatac

SEQ ID NO: 1263 - DNA, 79 bp, Orenia sp. Z6
  misc_feature (1)..(79): LWDV01000010.1/757336-757414 Orenia sp. Z6 2524618313, whole genome shotgun sequence
cataaaattggtgatgaggcttaccttgatattcttgatatatcaaaaccgtctttagactaatagcttctactcccta

SEQ ID NO: 1264 - DNA, 63 bp, Nitrobacter sp. 62-23 SCN
  misc_feature (1)..(63): MKSM01000141.1/15485-15423 Nitrobacter sp. 62-23 SCNpilot_cont_300_bf_scaffold_967, whole genome shotgun sequence
tttgtacatggcgatggagttcgccttttaaccgccctcggggctgatgactcctgtcgagcc

SEQ ID NO: 1265 - DNA, 65 bp, Bacteroidales bacterium 36-12 SCNpilot_bf_inoc_scaffold_680
  misc_feature (1)..(65): MKSZ01000133.1/24711-24647 Bacteroidales bacterium 36-12 SCNpilot_bf_inoc_scaffold_680, whole genome shotgun sequence
atagaaaaagggaatgggacttccctgaaaccgcttgaaatatagctgatagttcctacttaatg

SEQ ID NO: 1266 - DNA, 72 bp, Burkholderia sp. OLGA17
  misc_feature (1)..(72): CP014578.1/1835529-1835458 Burkholderia sp. OLGA172 chromosome 1, complete sequence
ttgcgcgctggggatggcattctccacatgctccattcgccgcccttgatggctggtgatgcctgcttcgcc

SEQ ID NO: 1267 - DNA, 66 bp, Deltaproteobacteria bacterium RIFCSPLOWO2
  misc_feature (1)..(66): MGSF01000017.1/5216-5151 Deltaproteobacteria bacterium RIFCSPLOWO2_02_FULL_50_16 rifcsplowo2_02_scaffold_13928, whole genome shotgun sequence
gaaaactttggcgatggagttcgccgtataaccgcctcaacacgggctgataactcctactcgtta

SEQ ID NO: 1268 - DNA, 66 bp, Nitrospirae bacterium
  misc_feature (1)..(66): MNVK01000062.1/4795-4860 Nitrospirae bacterium CG1_02_44_142 cg1_0.2_scaffold_17662_c, whole genome shotgun sequence
tttagtgtcggcgatggagttcgccgttaactgtccttttaagtggctgatgactcctaccacccc

SEQ ID NO: 1269 - DNA, 66 bp, Acetobacter tropicalis NBRC 101654; identical to SEQ ID NO: 710
  misc_feature (1)..(66): BABS01000034.1/15894-15829 Acetobacter tropicalis NBRC 101654 DNA, contig: 0034

SEQ ID NO: 1270 - DNA, 72 bp, Erysipelotrichaceae bacterium MTC7
  misc_feature (1)..(72): LVZN01000005.1/54206-54135 Erysipelotrichaceae bacterium MTC7 Contig_13, whole genome shotgun sequence
ctatgcgcagggaatgaaatctccctcgattacattatcgaaaccgcgcaagctaatgatttctgcattttt

SEQ ID NO: 1271 - DNA, 63 bp, Lactobacillus thailandensis DSM 22698
  misc_feature (1)..(63): AYZK01000011.1/8809-8871 Lactobacillus thailandensis DSM 22698 = JCM 13996 strain DSM 22698 Scaffold11, whole genome shotgun sequence
taagttcacggcgatgacgttcgcctttaaatattcgtaaggattgatgacgtctgtttattc

SEQ ID NO: 1272 - DNA, 115 bp, Oscillatoriales cyanobacterium JSC-12
  misc_feature (1)..(115): CM001633.1/2572890-2572776 Oscillatoriales cyanobacterium JSC-12 chromosome, whole genome shotgun sequence
tagggggatggcgatggagatcgccaaaaccgccttttgttttgcctaaagtctaaaatctggtgatttgaaacctaaaagctgaaaacataaggctgatggctcctacgattcc

SEQ ID NO: 1273 - DNA, 70 bp, Archaeon GW2011_AR4 QS99_C0014
  misc_feature (1)..(70): JWKP01000014.1/24045-24114 Archaeon GW2011_AR4 QS99_C0014, whole genome shotgun sequence
ttatctcttggcgatgaagtccgccatggatatgcccaaaaccgcctcagctgatgacttctaacaaagg

SEQ ID NO: 1274 - DNA, 60 bp, Thermoanaerobacter tengcongensis MB4
  misc_feature (1)..(60): AE008691.1/1840761-1840702 Thermoanaerobacter tengcongensis MB4, complete genome
tgcataaaaagtgatggaacccactttaaccgccgaaaggctgatggttcctacttgtga

SEQ ID NO: 1275 - DNA, 74 bp, [Clostridium] neopropionicum strain DSM-3847
  misc_feature (1)..(74): LRVM01000010.1/55507-55434 [Clostridium] neopropionicum strain DSM-3847 CLNEO_contig000010, whole genome shotgun sequence
taaattcttgggaatgaagttctcccaagggttaaacctaaaccgcttatttagccgatgacttctgcaattta

SEQ ID NO: 1276 - DNA, 59 bp, Moorella glycerini strain NMP; identical to SEQ ID NO: 1108
  misc_feature (1)..(59): CELZ01000010.1/89700-89758 Moorella glycerini strain NMP genome assembly, contig: M_glycerini_NMP_DRAFT_scaffold-10

SEQ ID NO: 1277 - DNA, 62 bp, [Clostridium] cellulosi
  misc_feature (1)..(62): LM995447.1/668610-668671 [Clostridium] cellulosi genome assembly, chromosome: I
ctttgtgttggtgatggggctcaccataatgcattacagatgctaatggctcctgctttaat

SEQ ID NO: 1278 - DNA, 71 bp, Cupriavidus sp. USMAA2-4
  misc_feature (1)..(71): CP017749.1/2322684-2322754 Cupriavidus sp. USMAA2-4 chromosome 2, complete sequence
gtcctcataggagatggcgttcctcctcataaccgccacgcgttcgcgtggctgatgacgcctacagactt

SEQ ID NO: 1279 - DNA, 81 bp, Candidatus Nitrososphaera gargensis Ga9.2
  misc_feature (1)..(81): CP002408.1/2823807-2823887 Candidatus Nitrososphaera gargensis Ga9.2, complete genome
aaaatgactggctatggcattagccttggcgtgagccagaaccgccctttttctaaaggagctgataatgcctaccaacaa

SEQ ID NO: 1280 - DNA, 85 bp, Planctomyces sp. SH-PL14
  misc_feature (1)..(85): CP011270.1/4418827-4418743 Planctomyces sp. SH-PL14, complete genome
gaataccttggcgatggggttccgccataaccgccgggagaatgccgcaaggtctgcctcccgcgctgatgactcctaccgattg

SEQ ID NO: 1281 - DNA, 64 bp, Clostridium acetobutylicum ATCC 824
  misc_feature (1)..(64): AE001437.1/1730397-1730460 Clostridium acetobutylicum ATCC 824, complete genome
aatttcataggtgatgaggttcgcccgtaaatatcctgtttggattgatgacttctgcataatt

SEQ ID NO: 1282 - DNA, 74 bp, Candidatus Izimaplasma sp. HR1
  misc_feature (1)..(74): CP009415.1/653563-653636 Candidatus Izimaplasma sp. HR1 chromosome, complete genome
ttatttttagggaatgaagtactcccttagtatttttactaaaaccgctataagctgatgacttctacgttatt

SEQ ID NO: 1283 - DNA, 80 bp, Clostridium sticklandii str. DSM 519
  misc_feature (1)..(80): FP565809.1/130293-130214 Clostridium sticklandii str. DSM 519 chromosome, complete genome
tatatttatgggaatgaagttctcccctagcagtatttgctaaaaccgctttttctagagctgatgacttctgtgagtat

SEQ ID NO: 1284 - DNA, 63 bp, Spirochaeta americana strain ASpG1
  misc_feature (1)..(63): FTMS01000015.1/78533-78471 Spirochaeta americana strain ASpG1 genome assembly, contig: Ga0071122_115
ttggcgcctggcgatggggctcgccacataaccgcctctccggctgacagtccctgtacaaca

SEQ ID NO: 1285 - DNA, 69 bp, Deltaproteobacteria bacterium GWA
  misc_feature (1)..(69): MGPO01000019.1/6796-6728 Deltaproteobacteria bacterium GWA2_65_63 gwa2_scaffold_16628, whole genome shotgun sequence
agcaaccaaggcgatggagttcgccgataaccgcctgtcgaacagacggctaatgactcctgcgatccc

SEQ ID NO: 1286 - DNA, 77 bp, Sphingomonas paucimobilis NBRC 13935
  misc_feature (1)..(77): BBJS01000043.1/250767-250843 Sphingomonas paucimobilis NBRC 13935 DNA, contig: SP643
cgcaggcacggcgatggatttccgccgggccattcggtcgaaccgccctcgcaagggccgatgattcctaccaggcg

SEQ ID NO: 1287 - DNA, 68 bp, Chryseobacterium arachidis strain DSM 27619
  misc_feature (1)..(68): FQUT01000001.1/582597-582530 Chryseobacterium arachidis strain DSM 27619 genome assembly, contig: Ga0131169_101
gctataaaaggaaatggtgttcttccttacccaaccgccttaaaaaagctgatgacgcctgattaaaa

SEQ ID NO: 1288 - DNA, 67 bp, Ralstonia solanacearum GMI1000
  misc_feature (1)..(67): AL646052.1/1941892-1941826 Ralstonia solanacearum GMI1000 chromosome complete sequence
ccggcctgcggagatggcatgcctcccttaaccgccgatcccatcggctgatgatgcctacaggttc

SEQ ID NO: 1289 - DNA, 64 bp, Bacillus sp. FJAT
  misc_feature (1)..(64): MAQW01000012.1/326540-326477 Bacillus sp. FJAT-27264 scaffold2, whole genome shotgun sequence
gatgaatcgggcgatggagttcgccattaaccgtcttttgcagactaatgactcctaccagtga

SEQ ID NO: 1290 - DNA, 73 bp, Pseudomonas syringae pv. actinidiae; identical to SEQ ID NO: 387
  misc_feature (1)..(73): AOKF01002523.1/2016-2088 Pseudomonas syringae pv. actinidiae ICMP 19096 scaffold37, whole genome shotgun sequence

SEQ ID NO: 1291 - DNA, 62 bp, Frateuria sp. Soil773
  misc_feature (1)..(62): LMSL01000040.1/129296-129357 Frateuria sp. Soil773 contig_8, whole genome shotgun sequence
ttccgatggggcgatggtgtccgccttcgactgccctcagggctgatgacacctacaggcta

SEQ ID NO: 1292 - DNA, 62 bp, Mycobacterium heidelbergense strain DSM 44471
  misc_feature (1)..(62): MVHR01000005.1/161584-161523 Mycobacterium heidelbergense strain DSM 44471 NODE_5_length_243907_cov_56.1658, whole genome shotgun sequence
tgcgagtaaggcgatgaagctcgcctcaaatgccgcccctggctaatggcttctacccagtg

SEQ ID NO: 1293 - DNA, 64 bp, Deltaproteobacteria bacterium
  misc_feature (1)..(8): MGQR01000021.1/6131-6068 Deltaproteobacteria bacterium RBG_16_50_11 RBG_16_scaffold_125085, whole genome shotgun sequence
aattgatttggtgatggagttcaccgtataaccgcctaagaaggctgataacttttgttttggg

SEQ ID NO: 1294 - DNA, 64 bp, Spirosoma linguale DSM 74
  misc_feature (1)..(64): CP001771.1/142912-142849 Spirosoma linguale DSM 74 plasmid pSLIN02, complete sequence
cctatcaaaggtgatggagttcgcctggaaccgccctcaaaaagctgataactcctgtattcgt

SEQ ID NO: 1295 - DNA, 60 bp, Methylocystis sp. SC2
  misc_feature (1)..(60): HE956757.1/1008434-1008493 Methylocystis sp. SC2 complete genome
ttccctacgggatggggctcccggtaaccgcctgatgaggctgatggctcctgccgcaag

SEQ ID NO: 1296 - DNA, 77 bp, Rhizobium taibaishanense strain 14971
  misc_feature (1)..(77): MKIN01000018.1/220870-220794 Rhizobium taibaishanense strain 14971 C181, whole genome shotgun sequence
atcggcaacggtaatggattctgccgggcattaagccgaaccgcttccccgatgaagctgatgactcctactcaacg

SEQ ID NO: 1297 - DNA, 60 bp, Armatimonadetes bacterium
  misc_feature (1)..(60): MNXM01000330.1/9225-9166 Armatimonadetes bacterium CG2_30_59_28 cg2_3.0_scaffold_2174_c, whole genome shotgun sequence
gagaaggctggcgatggagttcgccaattgtccgtgaggactgatgactcctatccgatt

SEQ ID NO: 1298 - DNA, 64 bp, Sodalis praecaptivus strain HS1
  misc_feature (1)..(64): CP006569.1/3268057-3268120 Sodalis praecaptivus strain HS1, complete genome
gacccatcaggagatgacattcctccttataaccgccgttctggctgatgatgtctacgttcgc

SEQ ID NO: 1299 - DNA, 71 bp, Firmicutes bacterium CAG:555
  misc_feature (1)..(71): HF986880.1/58759-58689 Firmicutes bacterium CAG:555 genomic scaffold, scf21
catcatatagggaatgaggtctcccgtggaggtatccaaaatcgcttagtgctgatgacttctgaaaaatc

SEQ ID NO: 1300 - DNA, 96 bp, Methylacidiphilum infernorum V4
  misc_feature (1)..(96): CP000975.1/1993796-1993891 Methylacidiphilum infernorum V4, complete genome
gaaatccctggcaatggagtttgccgtcccgccggttcgaagtacttgggaaaacctcctttcttgaaaagaaaggctgataactcctacttcaac

SEQ ID NO: 1301 - DNA, 78 bp, Treponema caldarium DSM 7334
  misc_feature (1)..(78): CP002868.1/2576532-2576609 Treponema caldarium DSM 7334, complete genome
aaggtatgaggtgatggagttcaccaacgagcgcattcgctctgaaccgccttcctggccgataactcctatgaagga

SEQ ID NO: 1302 - DNA, 71 bp, Eubacterium sp. CAG:603
  misc_feature (1)..(71): HF993782.1/19382-19452 Eubacterium sp. CAG:603 genomic scaffold, scf102
ataccacttgggaatgaagttctcccttggataaccagaaccgcttattagctgatgacttctgtaattaa

SEQ ID NO: 1303 - DNA, 63 bp, Alicyclobacillus macrosporangiidus strain DSM 17980
  misc_feature (1)..(63): FPBV01000009.1/76554-76616 Alicyclobacillus macrosporangiidus strain DSM 17980 genome assembly, contig: Ga0104483_109
aattcgataggtgatggagctcaccgtttacttcctgcaaaggatgatggctcctacggatag

SEQ ID NO: 1304 - DNA, 70 bp, Enterococcus faecalis V583; identical to SEQ ID NO: 917
  misc_feature (1)..(70): AE016830.1/2384514-2384445 Enterococcus faecalis V583, complete genome

SEQ ID NO: 1305 - DNA, 90 bp, Nocardia farcinica IFM 10152
  misc_feature (1)..(90): AP006620.1/61342-61253 Nocardia farcinica IFM 10152 plasmid pNF2 DNA, complete sequence
gagtccgcaggcgatggatctccgccgagacgaccgacctatgggccgtctgaaccgccccggtccggggctgatggttccttccccacg

SEQ ID NO: 1306 - DNA, 67 bp, Candidatus Rokubacteria bacterium
  misc_feature (1)..(67): MGBU01000051.1/1810-1744 Candidatus Rokubacteria bacterium GWA2_73_35 gwa2_scaffold_17261, whole genome shotgun sequence
cgccgtcaaggcgatggggttcgcctgaaaccgcccgacgcgtcgggctgatgacccctaccggagt

SEQ ID NO: 1307 - DNA, 64 bp, Serratia symbiotica strain CWBI-2.3T
  misc_feature (1)..(64): CCES01000002.1/45276-45339 Serratia symbiotica genome assembly, type strain CWBI-2.3T, contig: SYMBAF_Contig_10
acagcccctagagatatcattcctcccaaaccgccttcgcaaggctaatgatgtttacgtatag

SEQ ID NO: 1308 - DNA, 84 bp, Sphaerochaeta globosa str. Buddy
  misc_feature (1)..(84): CP002541.1/2695201-2695118 Sphaerochaeta globosa str. Buddy, complete genome
ctgcattcaggcgatggggttcgccgaaacctatttggtataaaccgcacgttataaacgtttgctgataactcctacaaattg

SEQ ID NO: 1309 - DNA, 77 bp, Agrobacterium vitis S4
  misc_feature (1)..(77): CP000633.1/960988-960912 Agrobacterium vitis S4 chromosome 1, complete sequence
cacggtaacggcaatggattctgccgggcacgacgccgaaccgcttccttgatgaagccgatgactcctactcaaca

SEQ ID NO: 1310 - DNA, 75 bp, Bifidobacterium stellenboschense strain DSM 23968
  misc_feature (1)..(75): JGZP01000012.1/331381-331455 Bifidobacterium stellenboschense strain DSM 23968 Contig12, whole genome shotgun sequence
ttgcacgcaggcgatggaacccgcccggaaacccgttttccgaaccgcattaccgctgatagttcctacacgatc

SEQ ID NO: 1311 - DNA, 66 bp, Chromobacterium amazonense strain DSM 26508
  misc_feature (1)..(66): MKCR01000003.1/233446-233511 Chromobacterium amazonense strain DSM 26508 Camzn_DSM26508.11, whole genome shotgun sequence
atctgatgcggagatggcattcctcccgtaaccgcctttgccaaggctgatgatgcctacagtatt

SEQ ID NO: 1312 - DNA, 62 bp, Planctomycetes bacterium
  misc_feature (1)..(62): MHYI01000054.1/4844-4783 Planctomycetes bacterium RBG_16_41_13 RBG_16_scaffold_16981, whole genome shotgun sequence
gaataaagaggcgatggagttcgcctgattgctatgtgatagctgataactcctattgaagt

SEQ ID NO: 1313 - DNA, 77 bp, Thermococcales archaeon
  misc_feature (1)..(77): LGET01000097.1/121-197 Thermococcales archaeon 44_46 PW_scaffold_576, whole genome shotgun sequence
aaggtcttgggcgatggcgtccgcctggggcttcgagcccgaaccgcccgctgagggctgatgacgcctgttctccg

SEQ ID NO: 1314 - DNA, 69 bp, Pedobacter sp. Leaf194; identical to SEQ ID NO: 955
  misc_feature (1)..(69): LMPU01000008.1/234928-234996 Pedobacter sp. Leaf194 contig_2, whole genome shotgun sequence

SEQ ID NO: 1315 - DNA, 68 bp, Sphingobacterium faecium
  misc_feature (1)..(68): FUKX01000032.1/617494-617561 Sphingobacterium faecium PCAi_F2.5 genome assembly, contig: Scaffold2
aaacaaaaaggaaatggtgttcttccttaaccaaccgccctcaaaaagctgatgacgcctgattaaaa

SEQ ID NO: 1316 - DNA, 63 bp, Pseudaminobacter manganicus strain JH-7
  misc_feature (1)..(63): MDET01000045.1/79833-79771 Pseudaminobacter manganicus strain JH-7 JH-7_scaffold5, whole genome shotgun sequence
tggaaacaaggggatggggttccccaaaaccgcccgacaagggctgatgactcctgctgtgtg

SEQ ID NO: 1317 - DNA, 79 bp, Thermomicrobium roseum DSM 5159
  misc_feature (1)..(79): CP001275.1/1997016-1996938 Thermomicrobium roseum DSM 5159, complete genome
gagtcgaacggcgatggagtccgccggggctcgtcgagagcccgaagcgccagagaaggctgatggctcctgctcgcag

SEQ ID NO: 1318 - DNA, 63 bp, Geobacillus kaustophilus HTA426
  misc_feature (1)..(63): BA000043.1/2726409-2726347 Geobacillus kaustophilus HTA426 DNA, complete genome
aatcgaataggcgatggagttcgccataaccgccggcttccggctgatgactcctgctgcaaa

SEQ ID NO: 1319 - DNA, 62 bp, Mycobacterium xenopi
  misc_feature (1)..(62): AJFI01000022.1/155770-155831 Mycobacterium xenopi RIVM700367 contig22, whole genome shotgun sequence
atcagcccaggcgatgaagctcgccttgaccgccaccaaaggctgatggcttctaccacaga

SEQ ID NO: 1320 - DNA, 70 bp, Carnobacterium sp. CP1
  misc_feature (1)..(70): CP010796.1/1214934-1215003 Carnobacterium sp. CP1, complete genome
aagtaaataggcgatggtgttcgcccttaactatcatagtaagtttatgattaatgacgcctacttaaga

SEQ ID NO: 1321 - DNA, 69 bp, Bacteroidetes bacterium
  misc_feature (1)..(69): MEOY01001160.1/628-696 Bacteroidetes bacterium RIFCSPHIGHO2_02_FULL_44_7 rifcsphigho2_02_scaffold_415318, whole genome shotgun sequence
taatcagaaggcgatgaggttcgccgaaaaccgcccaagataagttgggataataacctctactgaaaa

SEQ ID NO: 1322 - DNA, 65 bp, Mycobacterium sherrisii strain BC1_M4
  misc_feature (1)..(65): MIHC01000025.1/46527-46463 Mycobacterium sherrisii strain BC1_M4 PROKKA_contig000025, whole genome shotgun sequence
ttcgcggtcggcgatgaggctccgcccgctacgcgtcgcccgacgctgatggcttctaccccgca

SEQ ID NO: 1323 - DNA, 80 bp, Nitrospirae bacterium 531
  misc_feature (1)..(80): MHEU01000060.1/5182-5261 Nitrospirae bacterium RIFCSPLOWO2_02_FULL_62_14 rifcsplowo2_02_scaffold_5531, whole genome shotgun sequence
catcgtttaggtgatggagttcacctaaaactgtccgtaactttggtacaaggttgcggactaataactcctaccagcac

SEQ ID NO: 1324 - DNA, 62 bp, Pseudomonas entomophila str. L48
  misc_feature (1)..(62): CT573326.1/3719897-3719836 Pseudomonas entomophila str. L48 chromosome,complete sequence
cgtggcccaggagatggcattcctccttgaaccgcctcagcgctgatgatgcctacgcaacc

SEQ ID NO: 1325 - DNA, 77 bp, Novosphingobium sp. Leaf2
  misc_feature (1)..(77): LMJY01000017.1/142940-143016 Novosphingobium sp. Leaf2 contig_4, whole genome shotgun sequence
ccgcaccacggtgatggatttccgccgggctatttggccgaaccgccctcgcaagggccgatgattcctacttggcg

SEQ ID NO: 1326 - DNA, 71 bp, Vibrio rumoiensis
  misc_feature (1)..(71): AJYK02000040.1/277-347 Vibrio rumoiensis 1S-45 1S-45_contig_19, whole genome shotgun sequence
caaatcacgggtgatggggttccacctttaaccgctcaaagtctttttgagatgatggctcctgctaggtg

SEQ ID NO: 1327 - DNA, 68 bp, Chryseobacterium piperi strain CTM
  misc_feature (1)..(68): JPRJ01000053.1/18246-18179 Chryseobacterium piperi strain CTM contig53, whole genome shotgun sequence
atgataaaaggaaatggtgttcttccttacccaaccgctttacataagctgatgacgcctgattaata

SEQ ID NO: 1328 - DNA, 81 bp, Sulfobacillus thermosulfidooxidans strain ZBY
  misc_feature (1)..(81): MDZE01000022.1/430989-430909 Sulfobacillus thermosulfidooxidans strain ZBY contig7, whole genome shotgun sequence
taaacaccaggcgatggattccgccttggacctaggtccagaacctccgtgcatagtgcggataatgactcctgccagatt

SEQ ID NO: 1329 - DNA, 65 bp, Thermanaeromonas toyohensis
  misc_feature (1)..(65): LT838272.1/2862748-2862812 Thermanaeromonas toyohensis ToBE genome assembly, chromosome: I
tgtaattgcggtgatggagtccaccgataaaatacccgtcaagggttgatgactcctacccgaaa

SEQ ID NO: 1330 - DNA, 73 bp, Cellulomonas sp. B6
  misc_feature (1)..(73): LNTD01000270.1/13282-13354 Cellulomonas sp. B6 contig_90, whole genome shotgun sequence
gctggtcgcggcgatggatcccgccggggcgtgacgcccgaaccgccgcacggctgatggttcctgctccggt

SEQ ID NO: 1331 - DNA, 63 bp, Thermus scotoductus SA-01
  misc_feature (1)..(63): CP001962.1/1051801-1051739 Thermus scotoductus SA-01, complete genome
taaagagagggcgatggagtccgcctgaaccgcccgaaacgggctgatgactcctaccgggaa

SEQ ID NO: 1332 - DNA, 61 bp, Clostridium sp. DMHC 10
  misc_feature (1)..(61): LGVB01000015.1/3022246-3022306 Clostridium sp. DMHC 10 contig_15, whole genome shotgun sequence
aactgaataggtgatgaagttcgccttaactatcttttagattaatgacttctacatttta

SEQ ID NO: 1333 - DNA, 61 bp, Rhizobiales bacterium
  misc_feature (1)..(61): MKVZ01000019.1/51156-51096 Rhizobiales bacterium 63-22 SCNpilot_cont_500_bf_scaffold_96, whole genome shotgun sequence
catcgatgcggggatggagttccccttcacaagccggccggctgatgactcctaccgttgg

SEQ ID NO: 1334 - DNA, 73 bp, Firmicutes bacterium CAG:
  misc_feature (1)..(73): FR888936.1/21289-21361 Firmicutes bacterium CAG:466 genomic scaffold, scf203
agattgtaagggaatgaggttctcccgcggcaatgccggaaacgctgaaacagctgatgacttctgtaaaatc

SEQ ID NO: 1335 - DNA, 62 bp, Bosea sp. 6
  misc_feature (1)..(62): MKSQ01000024.1/26007-25946 Bosea sp. 67-29 SCNpilot_expt_1000_bf_scaffold_559, whole genome shotgun sequence
ttgccgaggagggatggagtccccccaaaccgccttaaccggctgatgactcctacaagcgc

SEQ ID NO: 1336 - DNA, 61 bp, Pseudobacteroides cellulosolvens ATCC 35603
  misc_feature (1)..(61): LGTC01000001.1/6367484-6367424 Pseudobacteroides cellulosolvens ATCC 35603 = DSM 2933 ctg1, whole genome shotgun sequence
aattaaataggtgatggagttcgccattaactgctattatgctaatgactcctacataatt

SEQ ID NO: 1337 - DNA, 73 bp, Eubacterium cylindroides T2-87; identical to SEQ ID NO: 443
  misc_feature (1)..(73): FP929041.1/1733794-1733866 Eubacterium cylindroides T2-87 draft genome

SEQ ID NO: 1338 - DNA, 63 bp, Paenibacillus sp.
  misc_feature (1)..(63): JXAK01000039.1/9322-9384 Paenibacillus sp. VKM B-2647 B-2647_039, whole genome shotgun sequence
tgttcataaggcgatggagttcgccataaaccgccggtaacggctaatgactcctaccagatt

SEQ ID NO: 1339 - DNA, 67 bp, Burkholderia pseudomallei strain K96243
  misc_feature (1)..(67): BX571966.1/2539005-2538939 Burkholderia pseudomallei strain K96243, chromosome 2, complete sequence
gcggcgaccggagatggcatgcctccgtacaaccgccggcgagccggctgatgatgcctacgcgttc

SEQ ID NO: 1340 - DNA, 63 bp, Burkholderia sp.
  misc_feature (1)..(63): AEXE01000084.1/3368-3306 Burkholderia sp. TJI49 contig072, whole genome shotgun sequence
gaaccgcagggagatggcatcctccccaaaccgcccgatcgggctgatgacgcctgcccacgc

SEQ ID NO: 1341 - DNA, 74 bp, Piscirickettsia sp.
  misc_feature (1)..(74): MDTU01000001.1/1022125-1022198 Piscirickettsia sp. Y2 scaffold00001, whole genome shotgun sequence
tctctggcaggtgatggagttcaccttaagcaatcgctttaaaccgcactcatgctaatgactcctgctacaat

SEQ ID NO: 1342 - DNA, 75 bp, Lactobacillus diolivorans DSM 14421
  misc_feature (1)..(75): AZEY01000007.1/5773-5699 Lactobacillus diolivorans DSM 14421 NODE_13, whole genome shotgun sequence
tattaaaacggcgatgacgttcgcccttactcagcagtgttaacacaccaaagagttgatgacgtctactttaac

SEQ ID NO: 1343 - DNA, 66 bp, Lysobacter antibioticus strain 76
  misc_feature (1)..(66): CP011129.1/5704756-5704821 Lysobacter antibioticus strain 76, complete genome
cttagggaaggagatggcattcctccttgaactgccggttttctggctgatgatgcctaccgcacc

SEQ ID NO: 1344 - DNA, 65 bp, Clostridium saccharobutylicum DSM 13864
  misc_feature (1)..(65): CP006721.1/434167-434231 Clostridium saccharobutylicum DSM 13864, complete genome
attttcataggtgatgaagtttgcctttaaacatctcttagaagattaatgatttctactataaa

SEQ ID NO: 1345 - DNA, 60 bp, Thermoanaerobacter pseudethanolicus ATCC 33223
  misc_feature (1)..(60): CP000924.1/2271016-2270957 Thermoanaerobacter pseudethanolicus ATCC 33223, complete genome
ataccataaggtgatggagctcgccataaatgcggaaacgctgatggctcctattaggag

SEQ ID NO: 1346 - DNA, 73 bp, Clostridium bolteae CAG:59
  misc_feature (1)..(73): HF988337.1/77505-77577 Clostridium bolteae CAG:59 genomic scaffold, scf126
ataagtaccgggaatgaagttctcccttagtctgactagaaccgcttataaagctgatgacttctgcattatg

SEQ ID NO: 1347 - DNA, 71 bp, Burkholderiales bacterium
  misc_feature (1)..(71): MKUQ01000030.1/14795-14725 Burkholderiales bacterium 70-64 SCNpilot_expt_1000_bf_scaffold_318, whole genome shotgun sequence
ttggacgagggagatggcattcctcccgcattcgcgaaaccgccgcaacggctgatgatgcctgcaccgcc

SEQ ID NO: 1348 - DNA, 61 bp, Burkholderia sp.
  misc_feature (1)..(61): CP016434.1/935257-935317 Burkholderia sp. AD24 chromosome I sequence
ttgcgcgctggagatggcattctcccttaaccgccctcgggctgatgatgcctgctacgcc

SEQ ID NO: 1349 - DNA, 75 bp, Leptonema illini DSM 21528
  misc_feature (1)..(75): JH597773.1/966425-966499 Leptonema illini DSM 21528 genomic scaffold Lepilscaffold_1, whole genome shotgun sequence
tttagctcaggcgatggggttccgccttataaccgcccttctcttttgaagcgtgctgatgactcctaccactca

SEQ ID NO: 1350 - DNA, 62 bp, Streptococcus sp.
  misc_feature (1)..(62): KQ969157.1/201392-201453 Streptococcus sp. DD10 genomic scaffold scaffold00001, whole genome shotgun sequence
tatccataaagggatggtgctccctataaacgctagaaatagctgatggcgcctgttagaaa

SEQ ID NO: 1351 - DNA, 62 bp, Rhizobiales bacterium
  misc_feature (1)..(62): MKRQ01000189.1/476-537 Rhizobiales bacterium 68-8 SCNpilot_expt_1000_bf_scaffold_8828, whole genome shotgun sequence
atgcgtggcggggatggggtcccccgtataaccgccctgtggctgatgactcctgccagcgc

SEQ ID NO: 1352 - DNA, 84 bp, Rubrobacter xylanophilus DSM 9941
  misc_feature (1)..(84): CP000386.1/554775-554692 Rubrobacter xylanophilus DSM 9941, complete genome
gacgatacgggcgatgaggcccgccttccgggggctccgcctccggagaaccgcgccggcggcgctgatggcttctgccccgca

SEQ ID NO: 1353 - DNA, 76 bp, Elusimicrobia bacterium
  misc_feature (1)..(76): MGVM01000041.1/13941-14016 Elusimicrobia bacterium RIFOXYB2_FULL_48_7 rifoxyb2_full_scaffold_1989, whole genome shotgun sequence
attagcaacggagatggagttctcctttaacccaaccgctttaacttcattaaaagctgataactcctacaattaa

SEQ ID NO: 1354 - DNA, 63 bp, Spinacia oleracea cultivar SynViroflay
  misc_feature (1)..(63): AYZV02264506.1/1975-2037 Spinacia oleracea cultivar SynViroflay scaffold87291.con0006.1, whole genome shotgun sequence
ataaatagtggcaatgatgtctgccttgaaccgccttaataagctgatgacgtctacttttag

SEQ ID NO: 1355 - DNA, 75 bp, Hymenobacter sp.
  misc_feature (1)..(75): CP010056.1/30164-30238 Hymenobacter sp. DG25B plasmid, complete sequence
ccacaatctggtgatggggtaccaccacgaaccgccgaagccgttccgctttgcgctgatgactcctacgtttac

SEQ ID NO: 1356 - DNA, 63 bp, Solirubrobacterales bacterium
  misc_feature (1)..(63): MKSH01000219.1/12690-12752 Solirubrobacterales bacterium 70-9 SCNpilot_bf_inoc_scaffold_4893, whole genome shotgun sequence
ctgtatctgagcgatgaggctcgctcaaaccgtggctcagccgctgatggcctctgcccccag

SEQ ID NO: 1357 - DNA, 62 bp, Bacillus cereus ATCC 14579
  misc_feature (1)..(62): AE016877.1/4975681-4975742 Bacillus cereus ATCC 14579, complete genome
ataatcctaggcgatggagttcgccataaacgcgctgcttatcttatgactcctaccagtat

SEQ ID NO: 1358 - DNA, 72 bp, Deltaproteobacteria bacterium
  misc_feature (1)..(72): MGQO01000116.1/7675-7746 Deltaproteobacteria bacterium RBG_16_47_11 RBG_16_scaffold_21686, whole genome shotgun sequence
tataatcttggcgatgaagttcgccattaaatgctccctctcttatcgggggctgataacttctactggttt

SEQ ID NO: 1359 - DNA, 63 bp, Paraburkholderia susongensis strain LMG 29540
  misc_feature (1)..(63): FXAT01000003.1/185330-185392 Paraburkholderia susongensis strain LMG 29540 genome assembly, contig: Ga0139082_103
aattgacgtggagatggcattcctccctaaccgcccgcaagggctaatgatgcctacaggcct

SEQ ID NO: 1360 - DNA, 61 bp, Pedobacter sp.
  misc_feature (1)..(61): LMPU01000001.1/488329-488269 Pedobacter sp. Leaf194 contig_1, whole genome shotgun sequence
ttgaaccatggcgatggggtaccgccaaaaccgccaacaggctgatgactcctacgatttt

SEQ ID NO: 1361 - DNA, 59 bp, Virgibacillus soli strain PL205; identical to SEQ ID NO: 870
  misc_feature (1)..(59): LGPD01000045.1/73083-73025 Virgibacillus soli strain PL205 scaffold000045, whole genome shotgun sequence

SEQ ID NO: 1362 - DNA, 70 bp, Niastella vici strain DJ57
  misc_feature (1)..(70): LVYD01000065.1/59800-59869 Niastella vici strain DJ57 contig36, whole genome shotgun sequence
taatcaataggcgatggagttcgcctttgagcgccactttccacgcgtggctaatgactcctgtttcatg

SEQ ID NO: 1363 - DNA, 89 bp, Gordonia rhizosphera
  misc_feature (1)..(89): BAHC01000126.1/5797-5709 Gordonia rhizosphera NBRC 16068 DNA, contig: GORHZ126
aaggcccgcggtgatggatctcgccggggtgagcgtcaccgacgtggtcgcccgaaccgccgacatcggctgatagttcctgttcctgg

SEQ ID NO: 1364 - DNA, 60 bp, Clostridium tetanomorphum DSM 665
  misc_feature (1)..(60): APJS01000002.1/101420-101479 Clostridium tetanomorphum DSM 665 contig2, whole genome shotgun sequence
gaaatctgtggtgatggagttcgccattaaatgcgtaaagctaatgactcctacaaaata

SEQ ID NO: 1365 - DNA, 75 bp, Leifsonia sp.
  misc_feature (1)..(75): LMOZ01000003.1/513183-513109 Leifsonia sp. Leaf336 contig_3, whole genome shotgun sequence
tgatccagcggcgatggatctcgccggggcgtgaacgcccgaaccgcgacggtcgctgatagttcctgcgcttca

SEQ ID NO: 1366 - DNA, 76 bp, Firmicutes bacterium
  misc_feature (1)..(76): FR887608.1/8393-8318 Firmicutes bacterium CAG:41 genomic scaffold, scf25
ttaaataaagggaatgaggttctcccttagtataatactaaaaccgcttatttaagctgatgacttctgcactatt

SEQ ID NO: 1367 - DNA, 67 bp, Sodalis praecaptivus strain HS1
  misc_feature (1)..(67): CP006570.1/280332-280398 Sodalis praecaptivus strain HS1 plasmid pHS1, complete sequence
atttcataaggtgatggcgttccaccttaccttaaccgccctcagggctgatgacgcctgtcataac

SEQ ID NO: 1368 - DNA, 68 bp, Chryseobacterium sp.
  misc_feature (1)..(68): CP013293.1/1082699-1082632 Chryseobacterium sp. IHB B 17019, complete genome
gcaatacaaggaaatggtgttcttccttacccaaccgcttttcagaagctgatgacgcctgattaaga

SEQ ID NO: 1369 - DNA, 103 bp, Rhodanobacter sp. C03 NODE_6_length_218089_cov_16.1895_ID_11
  misc_feature (1)..(103): MUNT01000010.1/156311-156209 Rhodanobacter sp. C03 NODE_6_length_218089_cov_16.1895_ID_11, whole genome shotgun sequence
gaccactcgggagatggcatgcctcccgtttcgcggaagctttcggcatcccggaacaaaccacctctcgcccggcgttgaggttgatgatgcctgcaccacc

SEQ ID NO: 1370 - DNA, 80 bp, Pedobacter sp.
  misc_feature (1)..(80): LWHJ01000030.1/14380-14301 Pedobacter sp. CCM 8644 NODE_6_length_330457_cov_122.052_ID_11, whole genome shotgun sequence
atcaaaaaaggtgatggtgtaccacctatttaaaccgccctcaagtatattgtttgaggtatgatgacacctacttataa

SEQ ID NO: 1371 - DNA, 72 bp, Yokenella regensburgei ATCC 43003
  misc_feature (1)..(72): JH417874.1/1731346-1731275 Yokenella regensburgei ATCC 43003 genomic scaffold Scfld157, whole genome shotgun sequence
actctacaaggtgatggtgttccacctttcccaaccgccggcattcagccggatgatgacgcctgatataca

SEQ ID NO: 1372 - DNA, 59 bp, Caloramator australicus RC3
  misc_feature (1)..(59): CAKP01000082.1/165666-165724 Caloramator australicus RC3, WGS project CAKP01000000 data, contig: 2
gaaattataggtgatggggttcaccttaattgccttgtgctgataactcctacttttgt

SEQ ID NO: 1373 - DNA, 69 bp, Syntrophus sp.; identical to SEQ ID NO: 1041
  misc_feature (1)..(69): MICO01000116.1/2059-2127 Syntrophus sp. RIFOXYC2_FULL_54_9 rifoxyc2_full_scaffold_15789, whole genome shotgun sequence

SEQ ID NO: 1374 - DNA, 67 bp, Acinetobacter baumannii str. SDF
  misc_feature (1)..(67): CU468230.2/2879674-2879608 Acinetobacter baumannii str. SDF, complete genome
ttaaaacagggagatggcattcctcccttgaaaaaccgccgtattggctaatgatgcctacgttacc

SEQ ID NO: 1375 - DNA, 84 bp, Phormidium tenue
  misc_feature (1)..(84): MRCG01000023.1/67227-67144 Phormidium tenue NIES-30 NIES-30_Scaffold_23, whole genome shotgun sequence
catagaaaaggcgatggagctcgccaaaaccgccctacgtgagtcagatttgaccgcctaagggctaatggctcctactcattc

SEQ ID NO: 1376 - DNA, 71 bp, Hafnia alvei FB1
  misc_feature (1)..(71): CP009706.1/2399395-2399325 Hafnia alvei FB1, complete genome
ttgcggcgaggtgatggcgttccaccttacccaaccgcttcccctgagaagctgatgacgcctgatattac

SEQ ID NO: 1377 - DNA, 61 bp, Pseudoxanthomonas suwonensis strain J1
  misc_feature (1)..(61): CP011144.1/3480073-3480013 Pseudoxanthomonas suwonensis strain J1, complete genome
tgggccaacgggaatggggcttcccgcgaaccgccttcgggctgatagctcctacacaccg

SEQ ID NO: 1378 - DNA, 117 bp, Burkholderia sp.
  misc_feature (1)..(117): AP013058.1/774434-774318 Burkholderia sp. RPE64 DNA, chromosome 1, complete genome
atcgctcacggagatggcatgcctcccgcagatcatcgcaaaccgctggattgattacgtagctgacttacccgattgagtcgcctaattaagccagctaatgatgcctacgcgttc

SEQ ID NO: 1379 - DNA, 68 bp, Chryseobacterium indologenes strain CI_885
  misc_feature (1)..(68): LJOD01000002.1/294502-294435 Chryseobacterium indologenes strain CI_885 contig_2, whole genome shotgun sequence
atcaaaaaaggaaatggtgctcttccttacccaaccgctttacaaaagctgatgacgcctgattaaga

SEQ ID NO: 1380 - DNA, 85 bp, Fischerella sp.
  misc_feature (1)..(85): AGIZ01000005.1/353585-353669 Fischerella sp. JSC-11 ctg112, whole genome shotgun sequence
aataaaaaaggcgatggaactcgccataatcgccttctggtgatatttaatacttaatcaaaaggctgatggctcctacttctcc

SEQ ID NO: 1381 - DNA, 73 bp, Dorea formicigenerans
  misc_feature (1)..(73): FR890317.1/35643-35571 Dorea formicigenerans CAG:28 genomic scaffold, scf145
tctcagacagggaatgaggttctccctcaattacgattgaaaccgccaaatggctgatgacttctgtgaatcg

SEQ ID NO: 1382 - DNA, 77 bp, Anaerocolumna jejuensis DSM 15929
  misc_feature (1)..(77): FRAC01000031.1/82127-82051 Anaerocolumna jejuensis DSM 15929 genome assembly, contig: EJ31DRAFT_scaffold00026.26
ttgcagagtgggaatgaagttctcccctggtagacaatacctaaactgcttataaagctaatgacttctgtttaaat

SEQ ID NO: 1383 - DNA, 59 bp, Sporanaerobacter acetigenes DSM 13106
  misc_feature (1)..(59): FQXR01000016.1/22863-22805 Sporanaerobacter acetigenes DSM 13106 genome assembly, contig: EJ96DRAFT_scaffold00015.15
ataaataatggtgatggagttcaccaaaactgcattatgctaatgactcctacaggtaa

SEQ ID NO: 1384 - DNA, 65 bp, Pontibacter korlensis strain X14-1T
  misc_feature (1)..(65): CP009621.1/3032854-3032790 Pontibacter korlensis strain X14-1T, complete genome
gctacaaacggcaatgatgtctgccttgaaccgctctacccagagctgatgacttctactttaag

SEQ ID NO: 1385 - DNA, 73 bp, Bifidobacterium asteroides PRL2011
  misc_feature (1)..(73): CP003325.1/1273195-1273267 Bifidobacterium asteroides PRL2011, complete genome
tgagcctcgggcgatggaacccgcccggggcttgagccccgaaccgcaaaccgctgacagttcctgcaccatg

SEQ ID NO: 1386 - DNA, 71 bp, Tetrasphaera japonica T1-X7
  misc_feature (1)..(71): HF570958.1/2643127-2643057 Tetrasphaera japonica T1-X7 genomic scaffold, 1540_scaffold1
gatagggcgggtgatggaacccacccggggcgacgctccgaactgcgaccgctgatggctcctacgacgac

SEQ ID NO: 1387 - DNA, 69 bp, Nitrospirae bacterium
  misc_feature (1)..(69): MHEH01000185.1/2976-3044 Nitrospirae bacterium RBG_13_43_8 RBG_13_scaffold_6510, whole genome shotgun sequence
taaaaataaagcgatggagttcgcttaaccgttccgatagatatcgggactgataactcctaccaggat

SEQ ID NO: 1388 - DNA, 74 bp, Enterococcus cecorum DSM 20682
  misc_feature (1)..(74): KI535313.1/618130-618057 Enterococcus cecorum DSM 20682 = ATCC 43198 genomic scaffold adfme-supercont2.1, whole genome shotgun sequence
ccaaatatagggaatgaggttctcccttggtttttacctaaactgctattacagctgatgacttctatgatttt

SEQ ID NO: 1389 - DNA, 74 bp, Anaerostipes hadrus
  misc_feature (1)..(74): FP929061.1/1879515-1879588 Anaerostipes hadrus draft genome
aaagaaaaagggaatgaagttctccctcgaagagattcgaaaccgcttattaagctgatgacttctgtgcgatg

SEQ ID NO: 1390 - DNA, 160 bp, Desulfobacca sp.
  misc_feature (1)..(160): MGTH01000159.1/17659-17500 Desulfobacca sp. RBG_16_60_12 RBG_16_scaffold_4360, whole genome shotgun sequence
aggaagaatggcgatggagctcgcctgggaaacttttcatactgagttgcattccaagagtttttgatggccgccgcaggctttagccggcgccggatgtccgattgcgagtcggtatcatggcccgaaccgcgctgacgctgatggctcctgatctcac

SEQ ID NO: 1391 - DNA, 63 bp, Imtechella halotolerans
  misc_feature (1)..(63): AJJU01000010.1/56840-56902 Imtechella halotolerans K1 Contig10, whole genome shotgun sequence
ccttgttatggcaatgatgtctgccttgaaccgccttataaagctgatgacgtctataaagag

SEQ ID NO: 1392 - DNA, 73 bp, Pseudomonas syringae pv. tomato str. DC3000
  misc_feature (1)..(73): AE016853.1/5215709-5215637 Pseudomonas syringae pv. tomato str. DC3000, complete genome
cggcgcattggagatggcattcctccattaacaaaccgctgcgcccgtagcagctgatgatgcctacagaaac

SEQ ID NO: 1393 - DNA, 68 bp, Deltaproteobacteria bacterium
  misc_feature (1)..(68): MGQW01000036.1/1664-1597 Deltaproteobacteria bacterium RBG_16_64_85 RBG_16_scaffold_20158, whole genome shotgun sequence
aacatagcgggcgatggagttcgccgaaaccgcctgtccgcaagacggctgataactcctgcgaagaa

SEQ ID NO: 1394 - DNA, 81 bp, Streptomyces sp.
  misc_feature (1)..(81): GG753627.1/966677-966757 Streptomyces sp. e14 genomic scaffold supercont1.2, whole genome shotgun sequence
ctcgaccgtggcgatggatcccgcctggaccgcctccggtccgaaccgccccgatcccgggctgatggttcctgaccattg

SEQ ID NO: 1395 - DNA, 62 bp, Paraburkholderia sp.
  misc_feature (1)..(62): CP018811.1/3024504-3024565 Paraburkholderia sp. SOS3 chromosome 1, complete sequence
ttgcgcaccggagatggcattctcctttaaccgcccttgtggctgatgatgcctgcttcgtc

SEQ ID NO: 1396 - DNA, 71 bp, Sphingobium chungbukense strain DJ77
  misc_feature (1)..(71): LBIC01000020.1/54156-54226 Sphingobium chungbukense strain DJ77 contig00020, whole genome shotgun sequence
ggcatggacggcgatggatttccgcctggcttcggccgaaccgcctccgggctgatgattcctacctgctg

SEQ ID NO: 1397 - DNA, 85 bp, Leptolyngbya valderiana
  misc_feature (1)..(85): LSYZ01000275.1/8929-8845 Leptolyngbya valderiana BDU 20041 contig00275, whole genome shotgun sequence
ttcaaaacgggcgatggagctcgccccaaccgcctgcaaaccgccgcaaacggcagagtttaaggctgatggctcctacacttcc

SEQ ID NO: 1398 - DNA, 63 bp, Mariniphaga anaerophila strain DSM 26910
  misc_feature (1)..(63): FQUM01000002.1/657912-657850 Mariniphaga anaerophila strain DSM 26910 genome assembly, contig: Ga0131162_102
atttgcataggcaatgaggtctgccattaactgccgtaaaaagctgatgacttctaccagcaa

SEQ ID NO: 1399 - DNA, 77 bp, Burkholderia sp. ST111
  misc_feature (1)..(77): LGIO01000031.1/91888-91812 Burkholderia sp. ST111 contig_31, whole genome shotgun sequence
tggcgcgctggagatggcattctcccgatggcattctcacttaaccgccctcgatggctgatgatgcctgcttcgcc

SEQ ID NO: 1400 - DNA, 74 bp, Clostridium sp. N3C
  misc_feature (1)..(74): FMJL01000016.1/7643-7570 Clostridium sp. N3C genome assembly, contig: N3C_contig16
atcatcaaggggaatgaagttctcccttggtttatacctaaaccgcatttaacgctaatgacttctgttttctt

SEQ ID NO: 1401 - DNA, 61 bp, Hyphomicrobium sp.
  misc_feature (1)..(61): MEEB01000351.1/1777-1717 Hyphomicrobium sp. SCN 65-11 ABS54_C0351, whole genome shotgun sequence
tcgtgggatggggatggggtcccccgacaactgctgaaaggctgatggctcctgccagacc

SEQ ID NO: 1402 - DNA, 63 bp, Desulfacinum hydrothermale DSM 13146
  misc_feature (1)..(63): FWXF01000009.1/42569-42507 Desulfacinum hydrothermale DSM 13146 genome assembly, contig: EJ40DRAFT_scaffold00009.9
tgcgatctaggcgatgaggctcgccttggaaccgcccttcgggctgatggcctctagggaagc

SEQ ID NO: 1403 - DNA, 68 bp, Elizabethkingia anophelis
  misc_feature (1)..(68): CP007547.1/929790-929723 Elizabethkingia anophelis NUHP1, complete genome
acaaaaagaggaaatggtgttcttcctcacccaaccgcttctgaggagctgatgacgcctgattaaat

SEQ ID NO: 1404 - DNA, 64 bp, Sediminibacterium ginsengisoli strain DSM 22335
  misc_feature (1)..(64): FUWH01000001.1/578761-578824 Sediminibacterium ginsengisoli strain DSM 22335 genome assembly, contig: Ga0070520_101
agtaatacaggaaatggtgtcttcctgacccaaccgctacagagctgatgacgcctgcaaattg

SEQ ID NO: 1405 - DNA, 104 bp, Rhodanobacter sp.
  misc_feature (1)..(104): MUNV01000026.1/22600-22497 Rhodanobacter sp. B04 NODE_2_length_497009_cov_12.5251_ID_3, whole genome shotgun sequence
tgggcaacgggagatggcatgcctcccgtttcgcgagcgcctgcggcattcccggaacaaaccacctctcgtccgtcgttgaggttgatgatgcctgcaccacc

SEQ ID NO: 1406 - DNA, 80 bp, Paramesorhizobium deserti strain A-3-E
  misc_feature (1)..(80): LNTU01000001.1/355243-355164 Paramesorhizobium deserti strain A-3-E Scaffold1, whole genome shotgun sequence
aatcgatgcggcaatggattctgccgggccggaaatggccgaaccgcttccccgatgaagctgatgactcctgctcattt

SEQ ID NO: 1407 - DNA, 62 bp, Mycobacterium heidelbergense strain DSM 44471
  misc_feature (1)..(62): MVHR01000007.1/97693-97632 Mycobacterium heidelbergense strain DSM 44471 NODE_7_length_175488_cov_52.3162, whole genome shotgun sequence
actgacagcggcgatggagcccgccctgaaccgccgatccggctgatggcccctgcgaacat

SEQ ID NO: 1408 - DNA, 68 bp, Triticum urartu cultivar G1812
  misc_feature (1)..(68): AOTI010596493.1/2825-2758 Triticum urartu cultivar G1812 contig596494, whole genome shotgun sequence
agataaaaaggaaatggtgctcttccttaaccaaccgcattataaatgctgatgacgcctgattaatt

SEQ ID NO: 1409 - DNA, 69 bp, Pseudomonas sp.
  misc_feature (1)..(69): AJWX01000005.1/215217-215149 Pseudomonas sp. M47T1 contig05, whole genome shotgun sequence
ttcgtgcccggagatggcattcctccccgaaccgccgcgctggccgcagctgatgatgcctacagacac

SEQ ID NO: 1410 - DNA, 71 bp, Thermincola sp.
  misc_feature (1)..(71): CP002028.1/582315-582385 Thermincola sp. JR, complete genome
tgtaaaaaaggcgatggggctcgccataattgctgatacataattgctcagctgatagctcctaccggtga

SEQ ID NO: 1411 - DNA, 65 bp, Sporomusa malonica strain DSM 5090
  misc_feature (1)..(65): FWXI01000013.1/79855-79919 Sporomusa malonica strain DSM 5090 genome assembly, contig: Ga0070592_113
caatctataggcgatggagttcgccattaaatccgttattatgcggtgatgactcctactagtaa

SEQ ID NO: 1412 - DNA, 70 bp, Alistipes indistinctus
  misc_feature (1)..(70): JH370371.1/1073259-1073190 Alistipes indistinctus YIT 12060 genomic scaffold supercont1.1, whole genome shotgun sequence
ggaagtacaggcaatggtatctgccttgaaccgccgcccggccgggtgcgctgatgatacctacagggct

SEQ ID NO: 1413 - DNA, 73 bp, Chryseobacterium sp.
  misc_feature (1)..(73): LMKA01000101.1/104821-104749 Chryseobacterium sp. Leaf201 contig_6, whole genome shotgun sequence
gcaacacagggaaatggtgttcttccttacccaaccgccctgtttcaacgggactgatgacgcctgattaaga

SEQ ID NO: 1414 - DNA, 63 bp, Propionispora sp. 2/2-37
  misc_feature (1)..(63): CYSP01000014.1/95346-95408 Propionispora sp. 2/2-37 isolate 2/2-37 genome assembly, contig: 2/2_contig14
ttcaataacggcgatggagttcgccctgaaccccgtgaaaacggtaatgactcctaccacgta

SEQ ID NO: 1415 - DNA, 74 bp, Propionibacterium freudenreichii subsp. shermanii
  misc_feature (1)..(74): FN806773.1/1882150-1882077 Propionibacterium freudenreichii subsp. shermanii CIRM-BIA1, complete genome
cctgaaaacggcgatgggacccgccggggcataagagcccgaaccgcagacctgctgatagttcctgttcgttg

SEQ ID NO: 1416 - DNA, 81 bp, Candidatus Acidianus copahuensis strain ALE1
  misc_feature (1)..(81): JFZT01000020.1/7527-7607 Candidatus Acidianus copahuensis strain ALE1 ctg7180000000532, whole genome shotgun sequence
agtgagacgggggatggcgtccccctgagggttttccctcaaactgcctaaacaatgagggctgatgacgcctatctctac

SEQ ID NO: 1417 - DNA, 74 bp, Humibacillus sp. DSM 29435
  misc_feature (1)..(74): MAST01000004.1/48439-48366 Humibacillus sp. DSM 29435 contig12, whole genome shotgun sequence
tgaggctcaggtgatggcgcccgcccggagcgtgagcttcgaaccgcagccctgctgatggcccctgttgatgg

SEQ ID NO: 1418 - DNA, 62 bp, Desulfotomaculum kuznetsovii DSM 6115
  misc_feature (1)..(62): CP002770.1/2632433-2632494 Desulfotomaculum kuznetsovii DSM 6115, complete genome
ctgctccacggcgatggagctcgcctggaatgcccggaaaggctgatggctcctaccaaaat

SEQ ID NO: 1419 - DNA, 70 bp, Candidatus Syntrophoarchaeum caldarius isolate BOX2
  misc_feature (1)..(70): LYOS01000002.1/254544-254613 Candidatus Syntrophoarchaeum caldarius isolate BOX2 BOX2_8_reassembly_contig02, whole genome shotgun sequence
gatgatagtggtgatgaggtccaccttggtttatgccaaaaccgctacagctaatgacttctaaataaaa

SEQ ID NO: 1420 - DNA, 61 bp, Methanospirillum hungatei JF-1
  misc_feature (1)..(61): CP000254.1/1238338-1238398 Methanospirillum hungatei JF-1, complete genome
tgtcatactggtgatggagttcaccaaaaccgccgttcgggctgataactcctacaggatg

SEQ ID NO: 1421 - DNA, 59 bp, Clostridium sp. BL8
  misc_feature (1)..(59): AUPA01000193.1/6290-6348 Clostridium sp. BL8 Contig44, whole genome shotgun sequence
aagttaaaaggtgatggagttcaccataaccgcaatatgctaatgactcctacaggtaa

SEQ ID NO: 1422 - DNA, 61 bp, Mycobacterium heidelbergense strain DSM 44471
  misc_feature (1)..(61): MVHR01000005.1/139483-139543 Mycobacterium heidelbergense strain DSM 44471 NODE_5_length_243907_cov_56.1658, whole genome shotgun sequence
ccctgacaaggcgatgaagctcgccttaaccgccgaaccggctgatggcttctacccgtgg

SEQ ID NO: 1423 - DNA, 71 bp, Sphingobium chungbukense strain DJ77; identical to SEQ ID NO: 400
  misc_feature (1)..(71): LBIC01000001.1/127094-127024 Sphingobium chungbukense strain DJ77 contig00001, whole genome shotgun sequence

SEQ ID NO: 1424 - DNA, 60 bp, Bacillus megaterium QM B1551
  misc_feature (1)..(60): CP001990.1/86509-86568 Bacillus megaterium QM B1551 plasmid pBM700, complete sequence
aatataaatggcgatggagttcgccaaaattgtcgttgtgctaatgactcctaccctttt

SEQ ID NO: 1425 - DNA, 74 bp, Anaerococcus lactolyticus ATCC 51172
  misc_feature (1)..(74): GG666045.1/116305-116378 Anaerococcus lactolyticus ATCC 51172 genomic scaffold SCAFFOLD2, whole genome shotgun sequence
atatttttagggaatgaagtactcccttgataattataatctaaaacgcgttggctgatgacttctacattttt

SEQ ID NO: 1426 - DNA, 62 bp, Desulfobacterium vacuolatum DSM 3385
  misc_feature (1)..(62): FWXY01000034.1/22182-22243 Desulfobacterium vacuolatum DSM 3385 genome assembly, contig: Ga0002809_134
aactgctcagggaatggggtttccctttaaccgcttgtaaagctgataactcctggttgaga

SEQ ID NO: 1427 - DNA, 78 bp, Ruminococcaceae bacterium CPB6
  misc_feature (1)..(78): CP020705.1/1280264-1280187 Ruminococcaceae bacterium CPB6, complete genome
atagaatatgggaatgaagttctcccatggtgaaaaaccggaactgctttcaaaagagctgatgacttctgcggtttt

SEQ ID NO: 1428 - DNA, 73 bp, Clostridium celatum DSM 1785
  misc_feature (1)..(73): KB291615.1/28458-28530 Clostridium celatum DSM 1785 genomic scaffold Scfld22, whole genome shotgun sequence
ttaaacatagggaatgaagttctcccttgatatctatcaaaatcgctaataagctaatgacttctacaacctt

SEQ ID NO: 1429 - DNA, 75 bp, Ruminococcaceae bacterium D16
  misc_feature (1)..(75): KI391947.1/598628-598554 Ruminococcaceae bacterium D16 genomic scaffold acsPy-supercont2.1, whole genome shotgun sequence
cgcaataaagggaatgaggtctcccttgtccttcgggactaaaccgcctacaaggctgatggcttctgcgatttt

SEQ ID NO: 1430 - DNA, 80 bp, Chthonomonas calidirosea T49
  misc_feature (1)..(80): HF951689.1/2549689-2549768 Chthonomonas calidirosea T49 complete genome
atggataacggtgatggaggccgccgagacgttttgacgtctgaaccgccgctttgtaggctaatggctcctggtcggat

SEQ ID NO: 1431 - DNA, 62 bp, Methylobacterium sp. 4-46
  misc_feature (1)..(62): CP000943.1/4458865-4458926 Methylobacterium sp. 4-46, complete genome
tggcggtctgggggtggagttccccataaccgcccacccgggccgatgactcctaccgcgtg

SEQ ID NO: 1432 - DNA, 63 bp, Planctomycetes bacterium
  misc_feature (1)..(63): MHXP01000105.1/6401-6339 Planctomycetes bacterium GWA2_39_15 gwa2_scaffold_29798, whole genome shotgun sequence
tttatttcaggcgatggagttcgcccaactgctacgcttgtagctgataactcctattgaagc

SEQ ID NO: 1433 - DNA, 74 bp, Clostridium caminithermale DSM 15212
  misc_feature (1)..(74): FRAG01000049.1/6608-6535 Clostridium caminithermale DSM 15212 genome assembly, contig: EJ27DRAFT_scaffold00049.49
tttatagtagggaatgaagttctccctggaatgatgttccaaaccgctgatgagctaatgacttctatgcatat

SEQ ID NO: 1434 - DNA, 64 bp, Afipia sp. Root123D2
  misc_feature (1)..(64): LMDP01000005.1/166756-166693 Afipia sp. Root123D2 contig_5, whole genome shotgun sequence
gttacagatggggatggagtcccccgatacccgcccgtcgtgggctgatgactcctgctgggat

SEQ ID NO: 1435 - DNA, 89 bp, Massilia sp. WF1
  misc_feature (1)..(89): LELH02000025.1/36824-36912 Massilia sp. WF1 contig25, whole genome shotgun sequence
ataatcagcggagatggcattcctccccgtatcgctcgacaccgttcgacaccaaaccgcccttcggggctgatgatgcctgcacgttc

SEQ ID NO: 1436 - DNA, 60 bp, Clostridium colicanis DSM 13634
  misc_feature (1)..(60): LTBB01000007.1/122122-122181 Clostridium colicanis DSM 13634 CLCO_contig000007, whole genome shotgun sequence
aatattagtggcgatggagttcgcctttaaatgcgcaaagctgatgactcctacaaaatg

SEQ ID NO: 1437 - DNA, 70 bp, Kluyvera intermedia strain CAV1151
  misc_feature (1)..(70): CP011602.1/127305-127374 Kluyvera intermedia strain CAV1151, complete genome
gatcagcaaggtgatggcgttccaccttacccaaccgcttccctgtgaagctgatgacgcctggtatgac

SEQ ID NO: 1438 - DNA, 75 bp, Amantichitinum ursilacus strain IGB-41
  misc_feature (1)..(75): LAQT01000037.1/32472-32546 Amantichitinum ursilacus strain IGB-41 contig37, whole genome shotgun sequence
cgccctgcaggagatggcattcctcccagaaccgccgcgccgccctccggtgcagctgatgatgcctacgtaacc

SEQ ID NO: 1439 - DNA, 69 bp, Desertifilum sp. IPPAS
  misc_feature (1)..(69): MJGC01000053.1/54710-54642 Desertifilum sp. IPPAS B-1220 NODE_2_length_240057_cov_33.7793, whole genome shotgun sequence
atttgtaaaggtaatggagcttaccttaaaccgccaagctttagctcggctgatggctcctactattct

SEQ ID NO: 1440 - DNA, 65 bp, Halorubrum sp.; identical to SEQ ID NO: 695
  misc_feature (1)..(65): KE356576.1/907962-907898 Halorubrum sp. J07HR59 genomic scaffold scf7180000001382, whole genome shotgun sequence

SEQ ID NO: 1441 - DNA, 61 bp, Paenibacillus rhizosphaerae strain FSL R5-0378
  misc_feature (1)..(61): MRTP01000006.1/212158-212218 Paenibacillus rhizosphaerae strain FSL R5-0378 NODE_6_length_352458_cov_1.76218_ID_3980, whole genome shotgun sequence
aacaacataggcgatggagttcgcctttaaccgcccgtgagctaatgactcctaccagtgc

SEQ ID NO: 1442 - DNA, 70 bp, Candidatus Rokubacteria bacterium
  misc_feature (1)..(70): MNEG01000108.1/20597-20528 Candidatus Rokubacteria bacterium 13_1_40CM_68_15 13_1_40cm_scaffold_771, whole genome shotgun sequence
gacgaaaaaggcgatggggttcgcctgaaaccgcctcaccgaccgtgaggctgatgacccctaccggcag

SEQ ID NO: 1443 - DNA, 61 bp, Gillisia sp.; identical to SEQ ID NO: 263
  misc_feature (1)..(61): LT629737.1/2606979-2606919 Gillisia sp. Hel1_33_143 genome assembly, chromosome: I

SEQ ID NO: 1444 - DNA, 65 bp, Desulfovibrio mexicanus strain DSM 13116
  misc_feature (1)..(65): FZOC01000008.1/42168-42104 Desulfovibrio mexicanus strain DSM 13116 genome assembly, contig: Ga0070557_108
ctccaacaaggcgaaggagttcgcctctaaccgcttccgctgaagctgatgactcctgtccaggc

SEQ ID NO: 1445 - DNA, 60 bp, Bacillus koreensis strain DSM 16467
  misc_feature (1)..(60): LILC01000023.1/4351-4292 Bacillus koreensis strain DSM 16467 scaffold3, whole genome shotgun sequence
aatacatacagcgatggagttcgctataagtgccttcgggctgatgactcctactcattc

SEQ ID NO: 1446 - DNA, 88 bp, Arthrobacter sp. Soil763
  misc_feature (1)..(88): LMSH01000002.1/1244479-1244566 Arthrobacter sp. Soil763 contig_2, whole genome shotgun sequence
tctgttcacggtgatggatcccgccggaacgccttgcacccgctgcggacgttcgaaccgcctcccggctgatggttcctacctttgc

SEQ ID NO: 1447 - DNA, 65 bp, Lactobacillus bifermentans DSM 20003
  misc_feature (1)..(65): AZDA01000072.1/1632-1696 Lactobacillus bifermentans DSM 20003 NODE_106, whole genome shotgun sequence
aacagaacaggcgatgacgttcgccttcgaaaaccacatttgtgattgatgacgtctactttttg

SEQ ID NO: 1448 - DNA, 66 bp, Planctomycetes bacterium
  misc_feature (1)..(66): MHYK01000142.1/160-225 Planctomycetes bacterium RBG_16_55_9 RBG_16_scaffold_24606, whole genome shotgun sequence
ataagacttggggatggagtccccctttataatcgccttagccgggctgatgactcctaccgcgca

SEQ ID NO: 1449 - DNA, 64 bp, Aureimonas sp.
  misc_feature (1)..(64): LMOH01000001.1/41121-41184 Aureimonas sp. Leaf324 contig_1, whole genome shotgun sequence
catcgctacggggatggggttcccccgcaaccgcccgcgtcgggctgatgactcctatcgaaac

SEQ ID NO: 1450 - DNA, 63 bp, Mesorhizobium sp.
  misc_feature (1)..(63): MDFL01000126.1/40994-40932 Mesorhizobium sp. ORS3428 contig_4, whole genome shotgun sequence
ccaaaaaatggggatggggttcccccgaaaccgcccttaagggctgatgactcctgccaggcg

SEQ ID NO: 1451 - DNA, 66 bp, Mucilaginibacter sp.
  misc_feature (1)..(66): MDJS01000005.1/13684-13749 Mucilaginibacter sp. PPCGB 2223 NODE_5_length_405491_cov_165.226_ID_646, whole genome shotgun sequence
tactaagggggtgatggtgtaccacctatttgaaccgctgcaaaagctgatgacgcctgccaaata

SEQ ID NO: 1452 - DNA, 61 bp, Gluconobacter oxydans; identical to SEQ ID NO: 671
  misc_feature (1)..(61): CP000004.1/152206-152146 Gluconobacter oxydans 621H plasmid pGOX1, complete sequence

SEQ ID NO: 1453 - DNA, 97 bp, Vibrio sp. JCM 19231
  misc_feature (1)..(97): BBRZ01000042.1/20346-20250 Vibrio sp. JCM 19231 DNA, contig00042
tatggcgaaggtgatggggttccacctaattgaaccgccgaattgttgagacgctcagcgtcaaacaaccctctcggctgatgactcctactaaaat

SEQ ID NO: 1454 - DNA, 76 bp, Candidatus Nitrospira defluvii
  misc_feature (1)..(76): FP929003.1/4028302-4028377 Candidatus Nitrospira defluvii chromosome, complete genome
aaatcctcaggtgatggagttcaccgagaaccgccggtcgcgatcctcgccttcggctgataactcctaccagcgc

SEQ ID NO: 1455 - DNA, 64 bp, Delftia acidovorans SPH-1
  misc_feature (1)..(64): CP000884.1/3908908-3908971 Delftia acidovorans SPH-1, complete genome
ctgcacgatgggaatggagcttcccgaaacctccctgcgaagggctgatggctcctgccttggt

SEQ ID NO: 1456 - DNA, 68 bp, Stenotrophomonas panacihumi strain JCM 16536
  misc_feature (1)..(68): LLXU01000106.1/25546-25613 Stenotrophomonas panacihumi strain JCM 16536 contig_67, whole genome shotgun sequence
ccgcgcacaggagatggcattcctcctcgaaccgcccgcacgcgtgggctgatgatgcctgccaagcc

SEQ ID NO: 1457 - DNA, 67 bp, Deltaproteobacteria bacterium RIFOXYD12
  misc_feature (1)..(67): MGTB01000013.1/8703-8637 Deltaproteobacteria bacterium RIFOXYD12_FULL_53_23 rifoxyd3_full_scaffold_1091, whole genome shotgun sequence
atacatgacggcgatggagttcgcctttaaacgccttgcccgcaaggctgatgactcctactcttga

SEQ ID NO: 1458 - DNA, 73 bp, Bacteria symbiont BFo1 of Frankliniella occidentalis strain BFo1
  misc_feature (1)..(73): JMSO01000176.1/25457-25385 Bacteria symbiont BFo1 of Frankliniella occidentalis strain BFo1 contig166, whole genome shotgun sequence
tcgctataaggtgatggtgttccacctttcccaaccgcctcgtccgtaaggggctgatgacgcctgataaccc

SEQ ID NO: 1459 - DNA, 70 bp, Terriglobus roseus strain GAS232
  misc_feature (1)..(70): LT629690.1/2302770-2302839 Terriglobus roseus strain GAS232 genome assembly, chromosome: I
caaccaaaaggcgatggggttcgccttgatgcccagcccacgggctggagctgatgactcctacgacagt

SEQ ID NO: 1460 - DNA, 73 bp, Niabella soli DSM 19437
  misc_feature (1)..(73): CP007035.1/698836-698908 Niabella soli DSM 19437, complete genome
tattaaacaggaaatggtgtcttcctgaaccaaaccgttcccactggcgggatctgatggcgcctgcaaatag

SEQ ID NO: 1461 - DNA, 64 bp, Burkholderia sp. TJI49
  misc_feature (1)..(64): AEXE01000084.1/9167-9104 Burkholderia sp. TJI49 contig072, whole genome shotgun sequence
ttggcgtcaggagatggcattctccttaaccgccgagacaccggatgatgatgcctactgcgtt

SEQ ID NO: 1462 - DNA, 73 bp, Hymenobacter sp. PAMC26628
  misc_feature (1)..(73): CP014304.1/4021829-4021901 Hymenobacter sp. PAMC26628, complete genome
ccacccaacggtgatggatttccaccgcgaaccgccggtgcttgtgcgccgcgctgatgattcctactgaact

SEQ ID NO: 1463 - DNA, 64 bp, Desulfotomaculum australicum DSM 11792
  misc_feature (1)..(64): FQUW01000005.1/6749-6812 Desulfotomaculum australicum DSM 11792 genome assembly, contig: EJ60DRAFT_scaffold00002.2
aacacaccgggcgatggagctcgcctttaagcgcctctttcgggctaatagctcctaccagagt

SEQ ID NO: 1464 - DNA, 60 bp, Clostridium botulinum A str
  misc_feature (1)..(60): AM412317.1/3416950-3416891 Clostridium botulinum A str. ATCC 3502 complete genome
agaattttgggcgatggagttcggcattaaatgcgtgaagctaatgactcctacaaatag

SEQ ID NO: 1465 - DNA, 82 bp, Omnitrophica WOR_2 bacterium GWA2_47_8
  misc_feature (1)..(82): MHFY01000089.1/39817-39898 Omnitrophica WOR_2 bacterium GWA2_47_8 gwa2_scaffold_2699, whole genome shotgun sequence
ttaaatttaggcgatggagttcgccggattttttataaaaccgctaacatatctttttaaagctgataactcctacggttct

SEQ ID NO: 1466 - DNA, 80 bp, Sphingomonas sp. LH128
  misc_feature (1)..(80): ALVC01000281.1/2711-2632 Sphingomonas sp. LH128 Contig281, whole genome shotgun sequence
tcggtgccaggcaatggatttctgcctgtccctctcttgagggccgaaccgccattttggctgatgattcctacctttcg

SEQ ID NO: 1467 - DNA, 62 bp, Mycobacterium kyorinense strain E861
  misc_feature (1)..(62): LZKJ01000166.1/72737-72798 Mycobacterium kyorinense strain E861 contig_66, whole genome shotgun sequence
atcccgctaggcgatgaagctcgccttaaccgccgcacctggctgatggcttctacccgtga

SEQ ID NO: 1468 - DNA, 62 bp, Thermobaculum terrenum ATCC BAA-798
  misc_feature (1)..(62): CP001825.1/675546-675485 Thermobaculum terrenum ATCC BAA-798 chromosome 1, complete sequence
ctgaatacaggcgatgaagctcgccttaagcgccgcacaaggctgatagcttctaccaagat

SEQ ID NO: 1469 - DNA, 62 bp, Candidatus Riflebacteria bacterium GWC2_50_8
  misc_feature (1)..(62): MFYY01000268.1/813-874 Candidatus Riflebacteria bacterium GWC2_50_8 gwc2_scaffold_9095, whole genome shotgun sequence
ctcatcacaggggatgaagtcccccgaaagcgccaaaccaggctaatgacttctaccagatt

SEQ ID NO: 1470 - DNA, 71 bp, Ruminococcus sp. CAG:353
  misc_feature (1)..(71): FR901374.1/15762-15832 Ruminococcus sp. CAG:353 genomic scaffold, scf223
cttaacaaagggaatgaagtgcgcccttgggaaaccaaaaccgcttattagctgatgacttctgcgatatt

SEQ ID NO: 1471 - DNA, 68 bp, Pyrinomonas methylaliphatogenes
  misc_feature (1)..(68): CBXV010000007.1/151298-151365 Pyrinomonas methylaliphatogenes, K22, WGS project CBXV01000000 data, contig: PYK22_K22_C11
tcgcgaaaaggcgatggagttcgcctaagaagcgtccaagaatttggactgatgactcctgcatcgtg

SEQ ID NO: 1472 - DNA, 79 bp, Clostridiales bacterium
  misc_feature (1)..(79): MNRI01000145.1/1526-1448 Clostridiales bacterium 52_15 Ley3_66761_scaffold_18972, whole genome shotgun sequence
agaataaacgggaatgaagttctcccgaagtaaccagattacttgaaccgctttgaaagctgatgacttctgcgacgaa

SEQ ID NO: 1473 - DNA, 65 bp, Mucilaginibacter pedocola strain TBZ30
  misc_feature (1)..(65): MBTF01000023.1/290123-290059 Mucilaginibacter pedocola strain TBZ30 scaffold3, whole genome shotgun sequence
ttcacgaagggcgatggtgctccgcctatttgaaccgctgcaaggctgatggctcccactcaaat

SEQ ID NO: 1474 - DNA, 65 bp, Enterococcus thailandicus strain F0711D
  misc_feature (1)..(65): LWMN01000013.1/126318-126382 Enterococcus thailandicus strain F0711D 46 Ent-16_S35_L001_001_5, whole genome shotgun sequence
aagtgaataggtgatggtgttcgcctttaaacgtttatcaataaactaatgacgcctactaaaaa

SEQ ID NO: 1475 - DNA, 78 bp, Clostridiales bacterium
  misc_feature (1)..(78): FR898162.1/4839-4916 Clostridium sp. CAG:288 genomic scaffold, scf4
atatttaatggaaatgatgtcttccaagttttactattaaacaaaaccgcttatttagctaatgacgtctatgatttt

SEQ ID NO: 1476 - DNA, 104 bp, Rhodanobacter sp.
  misc_feature (1)..(104): MHZQ01000303.1/3179-3076 Rhodanobacter sp. RIFOXYA1_FULL_67_6 rifoxya1_full_scaffold_25782, whole genome shotgun sequence
tggcccctcggagatggcatgcctcccgttccggaaccctcgggcacaccggaacaaaccgcttctcgtgatcccgcgttgaagttgatgatgcctgcaccccg

SEQ ID NO: 1477 - DNA, 69 bp, Rhodonellum psychrophilum GCM71
  misc_feature (1)..(69): AWXR01000011.1/52946-52878 Rhodonellum psychrophilum GCM71 = DSM 17998 strain GCM71 EFN26G1Q, whole genome shotgun sequence
atttcattcggcgatggggttccgccttacaaccgctccttttttggtgctgatgactcctacttcaac

SEQ ID NO: 1478 - DNA, 64 bp, Clostridium formicaceticum strain ATCC 27076
  misc_feature (1)..(64): CP017603.1/1723046-1723109 Clostridium formicaceticum strain ATCC 27076, complete genome
taattaaatggcgatggagttcgcccttaaccactgaaattcagttgatgactcctgtaaaaca

SEQ ID NO: 1479 - DNA, 59 bp, Clostridium amylolyticum strain DSM 21864
  misc_feature (1)..(59): FQZO01000013.1/31190-31132 Clostridium amylolyticum strain DSM 21864 genome assembly, contig: Ga0131114_113
ttttaaataggtgatggagttcaccataattgcggaatgctgatgactcctacaggtat

SEQ ID NO: 1480 - DNA, 61 bp, Rhizobiales bacterium
  misc_feature (1)..(61): MKVX01000018.1/234308-234368 Rhizobiales bacterium 62-47 SCNpilot_cont_300_bf_scaffold_6, whole genome shotgun sequence
aatgttgatggggatggggtcccccgacaaccgccgcgaggctgatgactcctaccgggcg

SEQ ID NO: 1481 - DNA, 71 bp, Deltaproteobacteria bacterium RBG_16_50_11
  misc_feature (1)..(71): MGQR01000021.1/7235-7165 Deltaproteobacteria bacterium RBG_16_50_11 RBG_16_scaffold_125085, whole genome shotgun sequence
tgatctcttggcgatgaggttcgccctcaaccgtcctatatttaagaaggactaataacttctactggatt

SEQ ID NO: 1482 - DNA, 59 bp, Coriobacteriaceae bacterium EMTCatB1
  misc_feature (1)..(59): BDLO01000001.1/1393809-1393867 Coriobacteriaceae bacterium EMTCatB1 DNA, scaffold1
tggagcacaggcgatggagctcgccttgaaccgcttcggctgatggctcctgcaccgga

SEQ ID NO: 1483 - DNA, 74 bp, Clostridiales bacterium
  misc_feature (1)..(74): MNRC01000153.1/2783-2856 Clostridiales bacterium 36_14 Ley3_66761_scaffold_17690, whole genome shotgun sequence
aaagaaaaagggaatgaagttctccctcgaagggattcgaaactgcttattaagctgatgacttctgtgtaatg

SEQ ID NO: 1484 - DNA, 63 bp, Serratia marcescens subsp. marcescens Db11
  misc_feature (1)..(63): HG326223.1/463488-463426 Serratia marcescens subsp. marcescens Db11, complete genome
cggcacgctggagatgacattcctccctaaccgccttcacaggctgatgatgtctacgtaacc

SEQ ID NO: 1485 - DNA, 79 bp, Lysobacter enzymogenes strain C3
  misc_feature (1)..(79): CP013140.1/2956134-2956056 Lysobacter enzymogenes strain C3 genome
atgaccggcggagatggcattcctccggtcctgtcgcgacaggcgaaccgccgccaaggctgatgatgcctgcccaccc

SEQ ID NO: 1486 - DNA, 63 bp, Betaproteobacteria bacterium CG2_30_68_42
  misc_feature (1)..(63): MNXU01000046.1/15457-15519 Betaproteobacteria bacterium CG2_30_68_42 cg2_3.0_scaffold_2887_c, whole genome shotgun sequence
ctgcccgcaggagatggcagtcctcctccaaccgcccgcgaggctgatgatgcctgcaatgac

SEQ ID NO: 1487 - DNA, 63 bp, Bacteroides luti strain DSM 26991
  misc_feature (1)..(63): FQTV01000020.1/20780-20718 Bacteroides luti strain DSM 26991 genome assembly, contig: Ga0131163_120
gcctgttttggcaatggcatctgccttaaaccgctcaattgagctgatgatacctacttaaag

SEQ ID NO: 1488 - DNA, 71 bp, Acidobacteria bacterium RIFCSPLOWO2_12_
  misc_feature (1)..(71): MELC01000038.1/206115-206185 Acidobacteria bacterium RIFCSPLOWO2_12_FULL_66_21 rifcsplowo2_12_scaffold_259, whole genome shotgun sequence
tgggccaacggcggtggagttcgccgaaaccgtccccgctcattggggggactgatgactcctactcgagg

SEQ ID NO: 1489 - DNA, 61 bp, Ornatilinea apprima strain P3M-1
  misc_feature (1)..(61): LGCL01000013.1/9108-9168 Ornatilinea apprima strain P3M-1 contig_26, whole genome shotgun sequence
ttttttattggtgatggagtccaccgttaattgctttattgctgatgactcctggattttt

SEQ ID NO: 1490 - DNA, 75 bp, Cellulomonas sp.
  misc_feature (1)..(75): MKTH01000014.1/142601-142527 Cellulomonas sp. 73-92 SCNpilot_cont_500_bf_scaffold_247, whole genome shotgun sequence
gtcgccgtcggcgatggatcccgcccgcgtcgatgacgacggaaccgccggccggctgatggttcctgctcccag

SEQ ID NO: 1491 - DNA, 58 bp, Desulfotomaculum nigrificans CO-1-SRB
  misc_feature (1)..(58): CP002736.1/343658-343715 Desulfotomaculum nigrificans CO-1-SRB chromosome, complete genome
aaattgaacggcgatggagttcgcctaacgctgccaagctgatgactcctacctttgt

SEQ ID NO: 1492 - DNA, 62 bp, Desulfovibrionaceae bacterium CG1_02_65_16
  misc_feature (1)..(62): MNUQ01000167.1/18676-18615 Desulfovibrionaceae bacterium CG1_02_65_16 cg1_0.2_scaffold_1191_c, whole genome shotgun sequence
tccagcaaaggggatggagtcccccttgaaccgcgacagccgctgatgactcctgctgcccg

SEQ ID NO: 1493 - DNA, 73 bp, Acidobacteria bacterium
  misc_feature (1)..(73): LLEU01000028.1/8512-8440 Acidobacteria bacterium OLB17 UZ17_ACD001CONTIG000028, whole genome shotgun sequence
ccaattccgggaaatggtgtcttcccgaaccgaaccgcgagcctgacgcgccgctgatgacgcctgtttttag

SEQ ID NO: 1494 - DNA, 62 bp, Alicyclobacillus sp. USBA-503
  misc_feature (1)..(62): FRAF01000044.1/2027-1966 Alicyclobacillus sp. USBA-503 genome assembly, contig: Ga0105849_144
tgatggtagggtgatggggctcacccaaacttcccagaagggataatggctcctgcgaatgg

SEQ ID NO: 1495 - DNA, 67 bp, Desulfococcus oleovorans Hxd3
  misc_feature (1)..(67): CP000859.1/3573766-3573832 Desulfococcus oleovorans Hxd3, complete genome
agaaacgatggggatggggtcccccgacaaccgccgcactggacaggctgatgactcctgccgatac

SEQ ID NO: 1496 - DNA, 64 bp, Yersinia pestis CO92
  misc_feature (1)..(64): AL590842.1/2918233-2918170 Yersinia pestis CO92 complete genome
tcaagatctggagatgacacgcctccataaccgccctaacaaggctaatgatgtctacgtgacc

SEQ ID NO: 1497 - DNA, 76 bp, Thermococcus sibiricus MM 739
  misc_feature (1)..(76): CP001463.1/457388-457463 Thermococcus sibiricus MM 739, complete genome
ttgccgttgggcgatggcgtccgcccggggcttcgggcccgaaccgcccacaagggctgatgacgcctgttctccg

SEQ ID NO: 1498 - DNA, 62 bp, Bacilli bacterium VT-13-104
  misc_feature (1)..(62): LAZH01000020.1/53148-53209 Bacilli bacterium VT-13-104 contig020, whole genome shotgun sequence
ttctaaatagacgatggagttcgccattaaccgtcttttcgactaatcactcctgccagttt

SEQ ID NO: 1499 - DNA, 59 bp, Methyloceanibacter methanicus strain R-67174
  misc_feature (1)..(59): LPWG01000013.1/305197-305139 Methyloceanibacter methanicus strain R-67174 contig_8, whole genome shotgun sequence
caattcgaaggggatggagtccccctgaaccgcccttggctgatgactcctgccgtgtc

SEQ ID NO: 1500 - DNA, 78 bp, Streptomyces sp. Tu6071
  misc_feature (1)..(78): CM001165.1/4044875-4044798 Streptomyces sp. Tu6071 chromosome, whole genome shotgun sequence
ctcgccacaggcgatgaatcccgccggggccccttacggcccgaaccgccctcccgggctgatggcttctgacaccca

SEQ ID NO: 1501 - DNA, 90 bp, Rhodanobacter sp. 115
  misc_feature (1)..(90): AJXS01000164.1/4499-4588 Rhodanobacter sp. 115 contig164, whole genome shotgun sequence
ggcgggaaaggagatggcatgcctccggttccacctcggaacaaaccgccccgatgtcatcaaacaggggctgatgatgcctgcaccacc

SEQ ID NO: 1502 - DNA, 70 bp, Halogeometricum pallidum JCM 14848
  misc_feature (1)..(70): AOIV01000036.1/89716-89647 Halogeometricum pallidum JCM 14848 contig_36, whole genome shotgun sequence
gatactcgtggcgatggagtccgccttaccccaaccgctggacccgccagctgatgactcctgtttccac

SEQ ID NO: 1503 - DNA, 73 bp, Enterococcus sp.
  misc_feature (1)..(73): NGLL01000001.1/2165996-2166068 Enterococcus sp. 2G9_DIV0600 scaffold00001, whole genome shotgun sequence
atgctaatcgggaatgaatgtctccctcagttcttactgaaaccgcaattttgctaatgacttctaccacttt

SEQ ID NO: 1504 - DNA, 65 bp, Megamonas hypermegale ART12/1
  misc_feature (1)..(65): FP929048.1/1688235-1688299 Megamonas hypermegale ART12/1 draft genome
taaatagatggtgatggagttcaccgataaatctgtatagatacagtaatgactcctgttatatt

SEQ ID NO: 1505 - DNA, 62 bp, Sinorhizobium fredii GR64
  misc_feature (1)..(62): AMCX01000055.1/33045-33106 Sinorhizobium fredii GR64 contig00055, whole genome shotgun sequence
taggagagtgggaatggtgtctcccctttaaccgcgctgatgctgatgacgcctgctgacga

SEQ ID NO: 1506 - DNA, 62 bp, Elusimicrobia bacterium
  misc_feature (1)..(62): MGVR01000325.1/2434-2373 Elusimicrobia bacterium RIFOXYD12_FULL_66_9 rifoxyd3_full_scaffold_33646, whole genome shotgun sequence
gggtcgtacggcgatggagttcgccacaaccgcccgcgggggctgatgactcctaccgaaaa

SEQ ID NO: 1507 - DNA, 63 bp, Alicyclobacillus ferrooxydans strain TC-34
  misc_feature (1)..(63): LJCO01000051.1/58159-58221 Alicyclobacillus ferrooxydans strain TC-34 contig_19, whole genome shotgun sequence
tccatagacggtgatggtgctcaccacaactgcctcaagaaggataatggcgcctgcaaatca

SEQ ID NO: 1508 - DNA, 61 bp, Thermobrachium celere DSM 8682
  misc_feature (1)..(61): HF952022.1/57931-57991 Thermobrachium celere DSM 8682 genomic scaffold, scaffold37
ataaactaaggtgatggagttcacctttaaccgccttttggctaatgactcctacagataa

SEQ ID NO: 1509 - DNA, 62 bp, Acidiphilium cryptum JF-5
  misc_feature (1)..(62): CP000697.1/351714-351653 Acidiphilium cryptum JF-5, complete genome
ggccgcgccggcgatggggttcgccgtgaaccgcccgcggggctgatgactcctgtttcgat

SEQ ID NO: 1510 - DNA, 63 bp, Lactobacillus johnsonii NCC 533
  misc_feature (1)..(63): AE017198.1/1172633-1172571 Lactobacillus johnsonii NCC 533, complete genome
aattgaataggtgatgacgttcaccaattaaactgagcaaaatctaacgacgtctacttccta

SEQ ID NO: 1511 - DNA, 77 bp, Globicatella sp. HMSC072A10
  misc_feature (1)..(77): LTFS01000131.1/2559-2483 Globicatella sp. HMSC072A10 Globicatella_spHMPREF2811-1.0_Cont338.1, whole genome shotgun sequence
ttaacgaaagggaatgaggttctccctaggtaagtttacctaaaccgcagttatttgctgatgacttctgtgacgct

SEQ ID NO: 1512 - DNA, 68 bp, Chryseobacterium sp. BLS98
  misc_feature (1)..(68): LFNF01000003.1/849128-849061 Chryseobacterium sp. BLS98 contig03, whole genome shotgun sequence
gcaacataaggaaatggtgttcttccttacccaaccgctttaccaaagctgatgacgcctgattaaca

SEQ ID NO: 1513 - DNA, 64 bp, Alicyclobacillus ferrooxydans strain TC-34
  misc_feature (1)..(64): LJCO01000051.1/58048-58111 Alicyclobacillus ferrooxydans strain TC-34 contig_19, whole genome shotgun sequence
aacaaatcaggtgatggagctcaccgttaacttcctgcaaaaggataatggctcctgcggacgg

SEQ ID NO: 1514 - DNA, 62 bp, Mycobacterium shimoidei strain HMC_M2
  misc_feature (1)..(62): MIHE01000032.1/32834-32895 Mycobacterium shimoidei strain HMC_M2 PROKKA_contig000032, whole genome shotgun sequence
tcgccgaaaggcgatgaagctcgccttaaccgccgcacctggctgatggcttctacccgttg

SEQ ID NO: 1515 - DNA, 69 bp, Lactobacillus paucivorans strain DSM 22467
  misc_feature (1)..(69): JQCA01000090.1/1056-1124 Lactobacillus paucivorans strain DSM 22467 NODE_144, whole genome shotgun sequence
aagttaatcggcgatgacgttcgccactaaaactaattggtaaatcaatttgatgacgtctactgcaca

SEQ ID NO: 1516 - DNA, 70 bp, Methanosarcina acetivorans str. C2A
  misc_feature (1)..(70): AE010299.1/4831358-4831427 Methanosarcina acetivorans str. C2A, complete genome
tgtaacaatggtgatgaggtccaccctgataattgtcaaaaccgcttatgctgatgacttctacacaact

SEQ ID NO: 1517 - DNA, 108 bp, Cyclobacterium lianum strain CGMCC 1.6102
  misc_feature (1)..(108): FRCY01000013.1/68704-68811 Cyclobacterium lianum strain CGMCC 1.6102 genome assembly, contig: Ga0070154_113
ccctatgatggtgatggggtgccaccaatgcttgcagatttccgggattaatactggttttcacaacacaaccgccgggactttctggctgatgactcctgtttcaag

SEQ ID NO: 1518 - DNA, 89 bp, Oscillatoria nigro-viridis PCC 7112
  misc_feature (1)..(89): CP003614.1/5761519-5761607 Oscillatoria nigro-viridis PCC 7112, complete genome
agtaatgatggcgatggagctcgccgaaaccgcccttcgttattaataatcttcataacgtttaaaaggctgatggctcctactgttcc

SEQ ID NO: 1519 - DNA, 77 bp, Sphingomonas sp. Leaf343; identical to SEQ ID NO: 771
  misc_feature (1)..(77): LMPG01000003.1/12954-12878 Sphingomonas sp. Leaf343 contig_11, whole genome shotgun sequence

SEQ ID NO: 1520 - DNA, 101 bp, Nitrospirae bacterium RBG_16_43_8
  misc_feature (1)..(101): MHEJ01000073.1/1243-1343 Nitrospirae bacterium RBG_16_43_8 RBG_16_scaffold_45301, whole genome shotgun sequence
cttaataacggcgatggggttcgccgttcatcccattagagaaaaatttctaacgggataaaccgttccgatgcttcgggactgatgactcctactctcaa

SEQ ID NO: 1521 - DNA, 62 bp, Paenibacillus sp. FSL H7-0737
  misc_feature (1)..(62): CP009279.1/3101747-3101808 Paenibacillus sp. FSL H7-0737, complete genome
atataacaaggcgatggagttcgccacaaccgtctcttcagactaatgactcctaccagagt

SEQ ID NO: 1522 - DNA, 62 bp, Desulfotomaculum sp. LMa1
  misc_feature (1)..(62): LYVF01000013.1/69725-69664 Desulfotomaculum sp. LMa1 LMA27_trimmed_contig_12, whole genome shotgun sequence
aacggttggggcgatggagctcgccattaactgctcttgcagctgatagctcctgttggacg

SEQ ID NO: 1523 - DNA, 72 bp, Clostridium sp. CAG:1013
  misc_feature (1)..(72): HF972668.1/15540-15611 Clostridium sp. CAG:1013 genomic scaffold, scf198
gaatttcacgggaatgaagtgctcccttgggaaacctaaaccgctttttaagctgatgacttctgcgagaca

SEQ ID NO: 1524 - DNA, 61 bp, Methylocystis bryophila strain S285
  misc_feature (1)..(61): CP019948.1/4131812-4131752 Methylocystis bryophila strain S285, complete genome
caccgaaatggggatggagtcccccgaaagcgccgcgatggctgatgactcctacaacccc

SEQ ID NO: 1525 - DNA, 69 bp, Comamonadaceae bacterium SCN 68-20
  misc_feature (1)..(69): MEFU01000001.1/26650-26718 Comamonadaceae bacterium SCN 68-20 ABT02_C0001, whole genome shotgun sequence
gtgcccgcaggagatggcgttcctcccctaaccaccgcgctgcgcgcggttgatgacgcctacagacac

SEQ ID NO: 1526 - DNA, 75 bp, Cetobacterium ceti strain ATCC 700028
  misc_feature (1)..(75): FUWX01000010.1/6757-6831 Cetobacterium ceti strain ATCC 700028 genome assembly, contig: EI52DRAFT_scaffold00007.7
aataaaaaagggaatgatgatctcccttagttataaactaaaactgcttataaagctgatgacgtctacattttt

SEQ ID NO: 1527 - DNA, 61 bp, Rhizobiales bacterium 63-22
  misc_feature (1)..(61): MKVZ01000019.1/52844-52904 Rhizobiales bacterium 63-22 SCNpilot_cont_500_bf_scaffold_96, whole genome shotgun sequence
ccagtcgtaggggatggagttccccctgaaccgccgtaaggctgatgactcctgaacggtc

SEQ ID NO: 1528 - DNA, 71 bp, Enterococcus sp. 9E7_DIV0242
  misc_feature (1)..(71): NGMM01000001.1/1091604-1091534 Enterococcus sp. 9E7_DIV0242 scaffold00001, whole genome shotgun sequence
gtctatgagggcgatggtgttcgccgataaatatttattttgaggaataaattgatgacgcctaccaaaca

SEQ ID NO: 1529 - DNA, 102 bp, Rhodanobacter sp. OK091
  misc_feature (1)..(102): FRCH01000003.1/261927-261826 Rhodanobacter sp. OK091 genome assembly, contig: Ga0115501_103
gttgccaggggagatggcatgcctcccgtttcgggcattcttcggcatcccgtgacaaaccacctctcgtccgtcgttgaggttgatgatgcctgcaccacc

SEQ ID NO: 1530 - DNA, 74 bp, Chitinophaga jiangningensis strain DSM 27406
  misc_feature (1)..(74): FRBL01000003.1/389150-389077 Chitinophaga jiangningensis strain DSM 27406 genome assembly, contig: Ga0131168_103
agtctaccaggaaatggtgtcttcctgctttgaaaccgtttcgcatcgccgaaactgatggcgcctacaaatat

SEQ ID NO: 1531 - DNA, 62 bp, Kluyvera ascorbata ATCC 33433
  misc_feature (1)..(62): JMPL01000110.1/7822-7883 Kluyvera ascorbata ATCC 33433 GKAS.assembly.110, whole genome shotgun sequence
ttatgcgtaggggatggcattcccccttgaaccgccgtgtggctgatgatgcctgtttgtat

SEQ ID NO: 1532 - DNA, 62 bp, Methylocystis sp. SC2
  misc_feature (1)..(62): HE956757.1/2510539-2510478 Methylocystis sp. SC2 complete genome
ttaacggatggggatggggttcccccgataaccgccgaaaggctgatgactcctgcgaactc

SEQ ID NO: 1533 - DNA, 77 bp, [Clostridium] celerecrescens strain 152B
  misc_feature (1)..(77): JPME01000010.1/371729-371805 [Clostridium] celerecrescens strain 152B c10, whole genome shotgun sequence
atagctcaagggaatgaagttctccctgtgctgattatagccgaaccgcttattaagctgatgacttctgcaataat

SEQ ID NO: 1534 - DNA, 62 bp, Dyella thiooxydans strain ATSB10
  misc_feature (1)..(62): CP014841.1/1961461-1961522 Dyella thiooxydans strain ATSB10, complete genome
ggacgcaagggagatggcatgcctccccgaaccgccgcaaggctgatgatgcctggtcgaac

SEQ ID NO: 1535 - DNA, 78 bp, Thermomicrobium roseum DSM 5159
  misc_feature (1)..(78): CP001276.1/661070-661147 Thermomicrobium roseum DSM 5159 plasmid, complete sequence
gtggtgcacggcgatgaggctcgccaggtggcttcggccaccgaagtgcccgctgcggctgatagcctctgctcgacc

SEQ ID NO: 1536 - DNA, 66 bp, Pedobacter sp. Hv1
  misc_feature (1)..(66): LLWP01000002.1/417118-417183 Pedobacter sp. Hv1 Contig02, whole genome shotgun sequence
agacaaaaaggaaatggtgtcttcctacttgaaccgccttaaaaagctgatgacgcctggttatta

SEQ ID NO: 1537 - DNA, 63 bp, Pseudomonas denitrificans ATCC 13867
  misc_feature (1)..(63): CP004143.1/1260953-1261015 Pseudomonas denitrificans ATCC 13867, complete genome
tgcgcggcaggagatggcattcctccttcaaccgccctcgtggctgatgatgcctacgcataa

SEQ ID NO: 1538 - DNA, 78 bp, Eubacterium sp. CAG:786
  misc_feature (1)..(78): HF989520.1/57872-57949 Eubacterium sp. CAG:786 genomic scaffold, scf497
atatcaccggggaatgacgtcctccccgtgggcatagccccgaaccgcaaatcttttgctgatggcatctgcgatatc

SEQ ID NO: 1539 - DNA, 74 bp, Tenericutes bacterium GWF2_57_13
  misc_feature (1)..(74): MICZ01000050.1/72332-72405 Tenericutes bacterium GWF2_57_13 gwf2_scaffold_822, whole genome shotgun sequence
atcgggtcggggaatgaagtgctcccttcgacatgttcgaaaaccgcctgacggctgatgacttctacgcgttt

SEQ ID NO: 1540 - DNA, 59 bp, Desulfotomaculum hydrothermale Lam5 = DSM 18033
  misc_feature (1)..(59): CAOS01000009.1/20614-20672 Desulfotomaculum hydrothermale Lam5 = DSM 18033, WGS project CAOS01000000 data, contig: ABX_2590_2
aaagtgaatggcgatggagttcgcctaacgctgttcaagctgatgactcctaccccttg

SEQ ID NO: 1541 - DNA, 78 bp, Desulfobacca sp. RBG_16_58_9
  misc_feature (1)..(78): MGTG01000089.1/3250-3327 Desulfobacca sp. RBG_16_58_9 RBG_16_scaffold_326703_curated, whole genome shotgun sequence
agcaattacggcgatggagtccgccggggcggccagaatccgcccgaaccgcgctacgctgatggctcctgctcacac

SEQ ID NO: 1542 - DNA, 65 bp, Arenibacter nanhaiticus strain CGMCC 1.8863
  misc_feature (1)..(65): FQYX01000026.1/15509-15445 Arenibacter nanhaiticus strain CGMCC 1.8863 genome assembly, contig: Ga0066783_126
gctacaattggcaatgatgtctgccttaaaccgttcctaatggagctaatgacttctacttttaa

SEQ ID NO: 1543 - DNA, 63 bp, Thermodesulfobium narugense DSM 14796
  misc_feature (1)..(63): CP002690.1/1077454-1077516 Thermodesulfobium narugense DSM 14796, complete genome
aaaaatatcggtgatggagttcaccgtaatgccccatagatggctgatgactcctagtatatt

SEQ ID NO: 1544 - DNA, 69 bp, Halarchaeum acidiphilum MH1-52-1
  misc_feature (1)..(69): BATA01000039.1/8119-8051 Halarchaeum acidiphilum MH1-52-1 DNA, contig: HAL039
gacgagcgcggcgatggcgtccgcccaccacaaccgccggacacgccggctgatgacgccttctcaccg

SEQ ID NO: 1545 - DNA, 73 bp, Blautia sp. YL58
  misc_feature (1)..(73): CP015405.2/2570795-2570723 Blautia sp. YL58, complete genome
tagttttaagggaatgaggttctcccgtggatgattccaaaagtgcgtgtatgctgatgacttctgtgtaaaa

SEQ ID NO: 1546 - DNA, 62 bp, Mycobacterium heraklionense strain Davo
  misc_feature (1)..(62): LDPO01000008.1/9003-9064 Mycobacterium heraklionense strain Davo contig_8, whole genome shotgun sequence
atccaggcaggcgatggagctcgcctttaaccgccgcaccggctgatggcttctaccagggc

SEQ ID NO: 1547 - DNA, 74 bp, Bifidobacterium subtile strain LMG 11597
  misc_feature (1)..(74): JGZR01000006.1/227799-227872 Bifidobacterium subtile strain LMG 11597 Contig06, whole genome shotgun sequence
atgaacagcgggtatgaggttcaccctgggcacacggcccgaaccgccttcgggctgatgacttctgcagggat

SEQ ID NO: 1548 - DNA, 68 bp, Enterococcus sp. 10A9_DIV0425
  misc_feature (1)..(68): NGMO01000001.1/906763-906696 Enterococcus sp. 10A9_DIV0425 scaffold00001, whole genome shotgun sequence
atgtaaataggcgatggtgttcgccatgaaatgttaatcagaagataactaatgacacctactaaaat

SEQ ID NO: 1549 - DNA, 61 bp, Bacillus enclensis strain SGD-1123
  misc_feature (1)..(61): KQ758490.1/5050-5110 Bacillus enclensis strain SGD-1123 genomic scaffold Scaffold9, whole genome shotgun sequence
aaccctacaggtgatggagttcacctttaaccgccggaaggctaatgactcctgtcagtgt

SEQ ID NO: 1550 - DNA, 65 bp, Candidatus Tectomicrobia bacterium RIFCSPLOWO2_12_
  misc_feature (1)..(65): MGDP01000031.1/488-552 Candidatus Tectomicrobia bacterium RIFCSPLOWO2_12_FULL_69_37 rifcsplowo2_12_scaffold_14005, whole genome shotgun sequence
ctgttgaacggggatggagtccccctcacaatcgcctgttttgggctgatgactcctgtcgcgag

SEQ ID NO: 1551 - DNA, 62 bp, Acidiferrobacter thiooxydans strain ZJ
  misc_feature (1)..(62): MDCF01000056.1/969-1030 Acidiferrobacter thiooxydans strain ZJ Contig_149, whole genome shotgun sequence
gagccaaagggcgatggggttcgccgtataaccgcctctgggctgatgactcctgaatgacc

SEQ ID NO: 1552 - DNA, 78 bp, Pandoraea pnomenusa strain RB-44
  misc_feature (1)..(78): CP006938.2/344694-344771 Pandoraea pnomenusa strain RB-44, complete genome
ctgctgcacggagatggcatacctccggcgttcctgcgcgaaccgctcctccccggggctgatgatgcctgcaagatc

SEQ ID NO: 1553 - DNA, 64 bp, Rhizobiales bacterium 65-79 S
  misc_feature (1)..(64): MKRJ01000017.1/20749-20812 Rhizobiales bacterium 65-79 SCNpilot_cont_1000_bf_scaffold_222, whole genome shotgun sequence
tgacatatcggggatggagtcccccctaaaccgccgttggacggctgatgactcctgccatgct

SEQ ID NO: 1554 - DNA, 65 bp, Bizionia argentinensis JUB59
  misc_feature (1)..(65): AFXZ01000044.1/4163-4227 Bizionia argentinensis JUB59 contig00057, whole genome shotgun sequence
caaatatttggcaatgaggtctgccttaaaccgttctatctagagctaatgacatctactttaat

SEQ ID NO: 1555 - DNA, 65 bp, [Clostridium] litorale DSM 5388 strain W6 CLIT_2c
  misc_feature (1)..(65): JJMM01000002.1/387613-387549 [Clostridium] litorale DSM 5388 strain W6 CLIT_2c, whole genome shotgun sequence
tcaatatcaggcgatggagctcgccttcaaacattgctgttgcaattgatggctcctgctggcct

SEQ ID NO: 1556 - DNA, 84 bp, Photobacterium profundum SS9
  misc_feature (1)..(84): CR354531.1/1717779-1717696 Photobacterium profundum SS9
attatgacgggagatgatgttcctcctttaactgccttactgaagtttacccttcttaataaggatgatgacgtctaacaacat

SEQ ID NO: 1557 - DNA, 64 bp, Bacterium AM6 strain AM6 2017-02-03
  misc_feature (1)..(64): MUYX01000049.1/5769-5706 Bacterium AM6 strain AM6 2017-02-03-Sterotrophomonas_trimmed_contig_49, whole genome shotgun sequence
gccgtcgatggggatggggctcccccgataaccgcctgagatggctgatggctcctgctgagac

SEQ ID NO: 1558 - DNA, 63 bp, Methanospirillum hungatei JF-1
  misc_feature (1)..(63): CP000254.1/1244505-1244443 Methanospirillum hungatei JF-1, complete genome
gtaaaccagggtgatggggttcacctgtaaccgctttttccagctgatgactcctcttcctgt

SEQ ID NO: 1559 - DNA, 68 bp, Candidatus Methanosphaerula palustris E1-9c
  misc_feature (1)..(69): CP001338.1/1058916-1058849 Candidatus Methanosphaerula palustris E1-9c, complete genome
gatggatgaggtgatggggtccacctcaattaaccgctcgtgtacgagctgatgactcctactaatct

SEQ ID NO: 1560 - DNA, 65 bp, Deltaproteobacteria bacterium GWA2_65_63
  misc_feature (1)..(65): MGPO01000019.1/8285-8221 Deltaproteobacteria bacterium GWA2_65_63 gwa2_scaffold_16628, whole genome shotgun sequence
acgcgtgaaggggatggagtccccctcataatcgcctacgcccggctgatgactcctaccgcgca

SEQ ID NO: 1561 - DNA, 62 bp, Clostridium colicanis 209318
  misc_feature (1)..(62): KB850956.1/10839-10900 Clostridium colicanis 209318 genomic scaffold acBRg-supercont1.1, whole genome shotgun sequence
aattttataggtcatggagttgacctttaaccgctttcaaagctgatgactcctgtagaact

SEQ ID NO: 1562 - DNA, 62 bp, Desulfotomaculum australicum DSM 11792
  misc_feature (1)..(62): FQUW01000005.1/8614-8675 Desulfotomaculum australicum DSM 11792 genome assembly, contig: EJ60DRAFT_scaffold00002.2
ctgctccatggcgatggagctcgcctggaatgcccggaaaggctgatggctcctaccaaaat

SEQ ID NO: 1563 - DNA, 62 bp, Planctomycetes bacterium RIFCSPHIGHO2_12_39_6
  misc_feature (1)..(62): MHYT01001093.1/1884-1945 Planctomycetes bacterium RIFCSPHIGHO2_12_39_6 rifcsphigho2_12_sub10_scaffold_9112, whole genome shotgun sequence
ttacgtccatgcgatggagttcgcctaaccgctataacatagctgataactcctattgaagc

SEQ ID NO: 1564 - DNA, 77 bp, Sphingomonas sp. Leaf412; identical to SEQ ID NO: 379
  misc_feature (1)..(77): LMQP01000002.1/551522-551598 Sphingomonas sp. Leaf412 contig_2, whole genome shotgun sequence

SEQ ID NO: 1565 - DNA, 67 bp, [Clostridium] thermoalcaliphilum strain DSM 7309
  misc_feature (1)..(67): MZGW01000001.1/276335-276269 [Clostridium] thermoalcaliphilum strain DSM 7309 CLOTH_contig000001, whole genome shotgun sequence
aaatatataggtgatggagttcacctttaactattgcaattttgcaattaatgactcctacttggac

SEQ ID NO: 1566 - DNA, 76 bp, Deltaproteobacteria bacterium GWD2_55_8
  misc_feature (1)..(76): MGPZ01000034.1/12910-12985 Deltaproteobacteria bacterium GWD2_55_8 gwd2_scaffold_1402, whole genome shotgun sequence
ttttgaacaggtgatggggttcaccttttaaccatcctggtctcattcagacgggattgataacccctaccagtgg

SEQ ID NO: 1567 - DNA, 71 bp, Acidobacteria bacterium RIFCSPLOWO2_12
  misc_feature (1)..(71): MELC01000038.1/206050-205980 Acidobacteria bacterium RIFCSPLOWO2_12_FULL_66_21 rifcsplowo2_12_scaffold_259, whole genome shotgun sequence
tgtgcgacgggtgttggagttcaccctcaaccgccctacctcttgacggggcagatgactcctacgggctt

SEQ ID NO: 1568 - DNA, 63 bp, Bosea sp. 67-29
  misc_feature (1)..(63): MKSQ01000024.1/22465-22403 Bosea sp. 67-29 SCNpilot_expt_1000_bf_scaffold_559, whole genome shotgun sequence
ttcataaatggtgatggagttcgccatttaaccgcccccagggctgatgactcctgtcgagcc

SEQ ID NO: 1569 - DNA, 61 bp, Sediminibacillus halophilus strain CGMCC 1.6199
  misc_feature (1)..(61): FNHF01000002.1/161501-161561 Sediminibacillus halophilus strain CGMCC 1.6199 genome assembly, contig: Ga0079860_102
ggatcgataggtgatggagttcacctttaaccgccgacaggctgatgactcctgccagtaa

SEQ ID NO: 1570 - DNA, 61 bp, Pseudorhodoplanes sinuspersici strain RIPI110
  misc_feature (1)..(61): CP021112.1/2665108-2665048 Pseudorhodoplanes sinuspersici strain RIPI110, complete genome
atcgatgatggggatggagtcccccgaaactgccgcagaggctgatgactcctatcgcgtt

SEQ ID NO: 1571 - DNA, 63 bp, Paraburkholderia caryophylli strain Ballard 720
  misc_feature (1)..(63): FXAH01000001.1/515764-515826 Paraburkholderia caryophylli strain Ballard 720 genome assembly, contig: Ga0139045_101
cgtgcgacaggagatggcatgcctcctcgaaccgccctcgtggctgatgatgcctaccttgtc

SEQ ID NO: 1572 - DNA, 62 bp, Burkholderiales bacterium 70-64
  misc_feature (1)..(62): MKUQ01000060.1/73427-73366 Burkholderiales bacterium 70-64 SCNpilot_expt_1000_bf_scaffold_93, whole genome shotgun sequence
tccgtcatgggagatggcatgcctccccgaaccgcctgacggctgatgatgcctaccggcca

SEQ ID NO: 1573 - DNA, 77 bp, Gammaproteobacteria bacterium RIFCSPHIGHO2_12
  misc_feature (1)..(77): MGYB01000092.1/204-280 Gammaproteobacteria bacterium RIFCSPHIGHO2_12_FULL_41_15 rifcsphigho2_12_scaffold_6720, whole genome shotgun sequence
cttaaatcgggagatggcattcctcctttaaaccgcttcttatctcaccgatcagagctgatgatgcctaccatgag

SEQ ID NO: 1574 - DNA, 69 bp, Providencia rettgeri strain MR4 P_rettgeri; identical to SEQ ID NO: 262
  misc_feature (1)..(69): LCVM01000112.1/16442-16510 Providencia rettgeri strain MR4 P_rettgeri_contig_112, whole genome shotgun sequence

SEQ ID NO: 1575 - DNA, 96 bp, Methylacidiphilum fumariolicum SolV,
  misc_feature (1)..(96): CAHT01000061.1/20583-20678 Methylacidiphilum fumariolicum SolV, WGS project CAHT01000000 data, contig: 77-2114
taataatctggcaatggagtttgccagcccgcgttttcgaagtgttttgggcaaaccccttttcttttaggaaaaggcgataactcctacttcaaa

SEQ ID NO: 1576 - DNA, 63 bp, Bacillus smithii strain DSM 4216
  misc_feature (1)..(63): CP012024.1/1739208-1739270 Bacillus smithii strain DSM 4216, complete genome
agctgaataggcgatggagttcgccgtataaccgtccatgcgactaatgactcctaccagtaa

SEQ ID NO: 1577 - DNA, 64 bp, Gluconacetobacter diazotrophicus PAl 5
  misc_feature (1)..(64): AM889285.1/3856660-3856597 Gluconacetobacter diazotrophicus PAl 5 complete genome
cgtccggtcggagatggagtacctccgtataaccgcccccagggctgatgactcctgctcgcat

SEQ ID NO: 1578 - DNA, 65 bp, Clostridia bacterium 62_21
  misc_feature (1)..(65): LGFR01000059.1/2947-3011 Clostridia bacterium 62_21 S_scaffold_859, whole genome shotgun sequence
cgtactgacggcgatggaacccgcctaacgccgccgaacgaacggctgatggttcctaccatttc

SEQ ID NO: 1579 - DNA, 64 bp, Streptomyces nodosus strain ATCC 14899
  misc_feature (1)..(64): CP009313.1/721578-721515 Streptomyces nodosus strain ATCC 14899 genome
aggggagtgggcgatgaggctcgccctcgaccgcacatcccgtgctgatggcctctgggagcga

SEQ ID NO: 1580 - DNA, 72 bp, Leifsonia xyli subsp. xyli str. CTCB07
  misc_feature (1)..(72): AE016822.1/68491-68420 Leifsonia xyli subsp. xyli str. CTCB07, complete genome
tggctctgcggcgatggatctcgccggggcgctgaccgaaccgtgatggccgctgatagttcctgcgcttct

SEQ ID NO: 1581 - DNA, 68 bp, Halococcus morrhuae DSM 1307
  misc_feature (1)..(68): AOMC01000135.1/53685-53618 Halococcus morrhuae DSM 1307 contig_135, whole genome shotgun sequence
cgcccatcgggcgatggggtccgcctttcacaaccgctgggcagccagctgatgactcctcccggaga

SEQ ID NO: 1582 - DNA, 85 bp, Coprococcus eutactus CAG:665
  misc_feature (1)..(85): HF998441.1/92082-92166 Coprococcus eutactus CAG:665 genomic scaffold, scf195
attataaaagggaatgaggttctcccttggaaaacctgaatgggcaacctaaactgctaatatagctgatgacttctacgattat

SEQ ID NO: 1583 - DNA, 71 bp, Klebsiella pneumoniae subsp. pneumoniae MGH 78578; identical to SEQ ID NO: 1376
  misc_feature (1)..(71): CP000650.1/81552-81622 Klebsiella pneumoniae subsp. pneumoniae MGH 78578 plasmid pKPN5, complete sequence

SEQ ID NO: 1584 - DNA, 77 bp, Clostridium sp. CAG:590
  misc_feature (1)..(77): HF987873.1/11923-11999 Clostridium sp. CAG:590 genomic scaffold, scf386
ttataggaagggaatgaagttctccctaagtagtgaatacttgaaccgcttattaagctgatgacttctgtgttaag

SEQ ID NO: 1585 - DNA, 77 bp, Bradyrhizobium yuanmingense strain BR3267
  misc_feature (1)..(77): LJYF01000012.1/170404-170480 Bradyrhizobium yuanmingense strain BR3267 contig1019, whole genome shotgun sequence
gtcgcagatggggatggagtcccccgacaaccgcccggcgatcgatgacctcatgggctgatgactcctgctcgagg

SEQ ID NO: 1586 - DNA, 61 bp, Chelatococcus sp. CO-6
  misc_feature (1)..(61): CP012398.1/3843722-3843662 Chelatococcus sp. CO-6, complete genome
gagaccgcaggggatggggtcccccgtaaccgccgcagaggctgatgactcctaccgggcg

SEQ ID NO: 1587 - DNA, 85 bp, Syntrophobacteraceae bacterium CG2_30_61_12
  misc_feature (1)..(85): MNZR01000273.1/3832-3748 Syntrophobacteraceae bacterium CG2_30_61_12 cg2_3.0_scaffold_3560_c, whole genome shotgun sequence
attgcgctaggcaatgaagtctgcctgaaccgccctcctttttgtctgcctgcaagcagcaagggctgatgacttctaccgtttc

SEQ ID NO: 1588 - DNA, 71 bp, Yokenella regensburgei ATCC 43003
  misc_feature (1)..(71): JH417874.1/2154575-2154645 Yokenella regensburgei ATCC 43003 genomic scaffold Scfld157, whole genome shotgun sequence
aagggttaaggtgatggcgttccaccttccccaaccgcccacaatgatgggctgatgacgcctggtatatc

SEQ ID NO: 1589 - DNA, 62 bp, Planctomycetes bacterium GWA2_39_15
  misc_feature (1)..(62): MHXP01000105.1/4565-4504 Planctomycetes bacterium GWA2_39_15 gwa2_scaffold_29798, whole genome shotgun sequence
gctaaaaagggcgatggagttcgccataattgctatgtatagctgataactcctattgaagc

SEQ ID NO: 1590 - DNA, 59 bp, [Clostridium] clariflavum DSM 19732
  misc_feature (1)..(59): CP003065.1/3427437-3427379 [Clostridium] clariflavum DSM 19732 chromosome, complete genome
tgaatatatggtgatggagttcacctgaattgcttaatgctgatgactcctacaggaat

SEQ ID NO: 1591 - DNA, 65 bp, Bacteroidia bacterium 44-10
  misc_feature (1)..(65): MKTE01000006.1/13414-13350 Bacteroidia bacterium 44-10 SCNpilot_bf_inoc_scaffold_1083, whole genome shotgun sequence
atttgtaaaggctatgggattagccgttaaccgcccgataaagagctgatgatccctactatacc

SEQ ID NO: 1592 - DNA, 65 bp, Moorella glycerini strain NMP
  misc_feature (1)..(65): CELZ01000050.1/62441-62505 Moorella glycerini strain NMP genome assembly, contig: M_glycerini_NMP_DRAFT_scaffold-50
tctccaaacggtgatggagttcaccggaaaaaccacccgtaagggttgatgactcctaccaagga

SEQ ID NO: 1593 - DNA, 72 bp, Deltaproteobacteria bacterium RBG_16_47_11
  misc_feature (1)..(72): MGQO01000116.1/8078-8149 Deltaproteobacteria bacterium RBG_16_47_11 RBG_16_scaffold_21686, whole genome shotgun sequence
atcagtcaaggcgatgaggttcgcctttaaccgtccttttattgagaaaggattgataacttctaccgggtc

SEQ ID NO: 1594 - DNA, 69 bp, Hydrogenobaculum sp. Y04AAS1
  misc_feature (1)..(69): CP001130.1/516815-516883 Hydrogenobaculum sp. Y04AAS1, complete genome
taaccacaaggagatggcgttctcctttaagcgcctccttcaaaagaggctgataacgcctacaagctc

SEQ ID NO: 1595 - DNA, 62 bp, Acidisphaera rubrifaciens HS-AP3
  misc_feature (1)..(62): BANB01000284.1/4316-4377 Acidisphaera rubrifaciens HS-AP3 DNA, contig: Asru_0284
tgccgcgatggggatggggtcccccgaaaccgcccgtccgggctgatgactcctgcgctttt

SEQ ID NO: 1596 - DNA, 63 bp, Caloramator quimbayensis strain USBA 833
  misc_feature (1)..(63): FUYH01000004.1/17531-17469 Caloramator quimbayensis strain USBA 833 genome assembly, contig: Ga0105845_104
aagtaaataggtgatgaagttcgccataattatcttttttagattgataacttctgcagtatt

SEQ ID NO: 1597 - DNA, 69 bp, Deltaproteobacteria bacterium GWC2_65_14
  misc_feature (1)..(69): MGPV01000033.1/5026-4958 Deltaproteobacteria bacterium GWC2_65_14 gwc2_scaffold_2584, whole genome shotgun sequence
gaagatcggggtgatggggttcacccggaaccgtccgccgggaggcgggctgatgactcctgcgatggc

SEQ ID NO: 1598 - DNA, 74 bp, Pantoea sp. PSNIH1
  misc_feature (1)..(74): CP009880.2/1007548-1007475 Pantoea sp. PSNIH1, complete genome
ctcagcacgggtgatggcgtaccacccgatccaaccgccgctgttttcagacggctgatgacgcctgactatac

SEQ ID NO: 1599 - DNA, 89 bp, Nocardia nova SH22a
  misc_feature (1)..(89): CP006850.1/5425559-5425647 Nocardia nova SH22a, complete genome
cggcggtcaggcgatgaagctccgcctgaccggtgcctccggacaccggtgcccccgtgccgaacggcactgatggcttctacccacag

SEQ ID NO: 1600 - DNA, 74 bp, Pyrinomonas methylaliphatogenes
  misc_feature (1)..(74): CBXV010000007.1/141761-141688 Pyrinomonas methylaliphatogenes, K22, WGS project CBXV01000000 data, contig: PYK22_K22_C11
aaaattcggggcgatggagttcgccgtataaccatctcggtcgccagatcgagattgatgactccttttcaagc

SEQ ID NO: 1601 - DNA, 59 bp, Lactobacillus helveticus DPC 4571
  misc_feature (1)..(59): CP000517.1/1061364-1061422 Lactobacillus helveticus DPC 4571, complete genome
aactaaataggtgatgacgttcaccattaaccgagagatctaatgacggctactttatc

SEQ ID NO: 1602 - DNA, 67 bp, Acinetobacter sp. CIP 102637
  misc_feature (1)..(67): KB849435.1/1926175-1926109 Acinetobacter sp. CIP 102637 genomic scaffold acLrO-supercont1.3, whole genome shotgun sequence
taggataaaggagatggcattcttcctgttacaaaccgccatagtggctaatgatgcctacgtgacc

SEQ ID NO: 1603 - DNA, 65 bp, Streptomyces griseofuscus strain NG1-7 NG1-17_1_1
  misc_feature (1)..(65): MTKC01000003.1/5832327-5832263 Streptomyces griseofuscus strain NG1-7 NG1-17_1_1, whole genome shotgun sequence
cgacgcgccggtgatggggctcaccgcaaccgcggcaccatgccgctgacggtccctggtcgaac

SEQ ID NO: 1604 - DNA, 70 bp, Dialister succinatiphilus YIT 11850
  misc_feature (1)..(70): JH591188.1/96457-96526 Dialister succinatiphilus YIT 11850 genomic scaffold supercont1.2, whole genome shotgun sequence
cccgcaaacggcgatggagttcgccgggcgtaggccgaatgctctttgagctgatgactcctgtccccct

SEQ ID NO: 1605 - DNA, 68 bp, Acinetobacter gerneri DSM 14967
  misc_feature (1)..(68): KB849539.1/187621-187554 Acinetobacter gerneri DSM 14967 = CIP 107464 genomic scaffold acLZs-supercont1.32, whole genome shotgun sequence
taaattaaaggaaatggctatcttccttctacaaaccgccactaacggctgatgatacctacgttacc

SEQ ID NO: 1606 - DNA, 90 bp, Nostoc sp. NIES-3756
  misc_feature (1)..(90): AP017295.1/143881-143970 Nostoc sp. NIES-3756 DNA, complete genome
taaatacaaggcgatggagctcgccacaaccgccttctgatttttacatacttaatactcgatcaaaaggctaatggctcctacttttcc

SEQ ID NO: 1607 - DNA, 76 bp, Verrucomicrobia bacterium 13_2_20CM_55_10; identical to SEQ ID NO: 458
  misc_feature (1)..(76): MNCN01000036.1/12631-12706 Verrucomicrobia bacterium 13_2_20CM_55_10 13_2_20cm_scaffold_1270, whole genome shotgun sequence

SEQ ID NO: 1608 - DNA, 65 bp, Chromobacterium violaceum ATCC 12472
  misc_feature (1)..(65): AE016825.1/2613318-2613254 Chromobacterium violaceum ATCC 12472, complete genome
ttctattgcggagatggcattcctcccgtaaccacccctagagggttgatgatgcctacggtatt

SEQ ID NO: 1609 - DNA, 100 bp, Aquitalea magnusonii strain SM6
  misc_feature (1)..(100): JZRC01000050.1/8689-8590 Aquitalea magnusonii strain SM6 contig_50, whole genome shotgun sequence
ttttctccgggagatggcattcctcccgcctgttggctgcttcctgcccggaagtcgctgcagcgaaccgcccgtccgggctgatgatgcctgcaggtat

SEQ ID NO: 1610 - DNA, 75 bp, Limnochorda pilosa
  misc_feature (1)..(75): AP014924.1/2829973-2830047 Limnochorda pilosa DNA, complete genome, strain: HC45
cgctgccccggcgatggagctcgccgttgccctcaggcaaggtcccgggatccgggtgatggctcctaccagcac

SEQ ID NO: 1611 - DNA, 63 bp, Kaistia sp.
  misc_feature (1)..(63): MEDI01000308.1/12732-12794 Kaistia sp. SCN 65-12 ABS35_C0308, whole genome shotgun sequence
ggcggcgatggggatggagttcccccgaaaccgcccgcgagggctgatgactcctaccgcaac

SEQ ID NO: 1612 - DNA, 71 bp, Raoultella planticola strain GCSL-DIFS-295; identical to SEQ ID NO: 1376
  misc_feature (1)..(71): JZSG01001632.1/861-791 Raoultella planticola strain GCSL-DIFS-295 CFSAN029441_contig1631, whole genome shotgun sequence

SEQ ID NO: 1613 - DNA, 62 bp, Candidate division KSB1 bacterium 4484_87
  misc_feature (1)..(62): NATN01000018.1/11848-11909 Candidate division KSB1 bacterium 4484_87 ex4484_87_scaffold_1483, whole genome shotgun sequence
actgatatgggcgatggagtccgcctgagactgctgtcagagctaatgactcctttttgtta

SEQ ID NO: 1614 - DNA, 66 bp, Sphingobacterium sp. 21
  misc_feature (1)..(66): CP002584.1/186490-186555 Sphingobacterium sp. 21, complete genome
ttgcgaaacggaaatgatgccttccgactgaaccgccttaaaaaagctgatggcgtctactaaaat

SEQ ID NO: 1615 - DNA, 62 bp, Thioalkalivibrio denitrificans strain ALJD
  misc_feature (1)..(62): MVBK01000001.1/109763-109702 Thioalkalivibrio denitrificans strain ALJD Ga0073317_1001, whole genome shotgun sequence
acagagccgggagatggcatccctcccaaaccgccctcgcggctgatgatgcctacactgct

SEQ ID NO: 1616 - DNA, 74 bp, Terriglobus saanensis SP1PR4
  misc_feature (1)..(74): CP002467.1/957934-957861 Terriglobus saanensis SP1PR4, complete genome
aacaacctgggcgatggggttccgccactaaccgcacgcgctgtatgcgcggagctgatgactcctacgagaca

SEQ ID NO: 1617 - DNA, 63 bp, Rhizobiales bacterium 63-22
  misc_feature (1)..(63): MKVZ01000012.1/36693-36755 Rhizobiales bacterium 63-22 SCNpilot_cont_500_bf_scaffold_404, whole genome shotgun sequence
cataatcaaggagatggagctctcctggtaaccgccttgtcggctgatggctcctgctgttga

SEQ ID NO: 1618 - DNA, 92 bp, Photobacterium aquae strain CGMCC 1.12159
  misc_feature (1)..(92): LDOT01000023.1/122968-122877 Photobacterium aquae strain CGMCC 1.12159 contig0023, whole genome shotgun sequence
cgcttggcgggagatgatgttcctcctttaaccgcctttcttgatcggccttgtgccatttgctcaaaaaggataatgacgtctagcaacac

SEQ ID NO: 1619 - DNA, 74 bp, Synechococcus elongatus PCC 7942
  misc_feature (1)..(74): CP000100.1/2263916-2263989 Synechococcus elongatus PCC 7942, complete genome
tacaagcagggtgatggagctcacctcaaccgcgcactcggcatggcccgatcgctgatggctcctacagttct

SEQ ID NO: 1620 - DNA, 70 bp, Serratia sp. ATCC 39006 c
  misc_feature (1)..(70): AWXH01000003.1/755831-755900 Serratia sp. ATCC 39006 ctg3, whole genome shotgun sequence
cctataaaaggtaatggcgtactaccttccccaaccgctatagaatatagctgatgacgcctggcttacg

SEQ ID NO: 1621 - DNA, 73 bp, [Eubacterium] eligens ATCC 27750
  misc_feature (1)..(73): CP001104.1/1954632-1954704 [Eubacterium] eligens ATCC 27750 chromosome, complete genome
aatatcaaagggaatgaagtactcccttgggaaacctaaactgcttattcaagctgatgacttctacgatttt

SEQ ID NO: 1622 - DNA, 65 bp, Nitrospira japonica strain NJ11
  misc_feature (1)..(65): LT828648.1/1869705-1869769 Nitrospira japonica isolate Genome sequencing of Nitrospira japonica strain NJ11 genome assembly, chromosome: I
atgtctacaggggatggggtcccccgtataaccgccacggccaggctgatgactcctacgtcgta

SEQ ID NO: 1623 - DNA, 82 bp, Acidianus manzaensis strain YN-25
  misc_feature (1)..(82): CP020477.1/2370032-2370113 Acidianus manzaensis strain YN-25, complete genome
ttatcttatgggaatggcgtctcccagagggtaactccctcaaaccgccagattaatgatggctgatgacgcctatctctat

SEQ ID NO: 1624 - DNA, 74 bp, Niastella vici strain DJ57
  misc_feature (1)..(74): LVYD01000057.1/27458-27385 Niastella vici strain DJ57 contig29, whole genome shotgun sequence
catcgcaaaggaaatggtgtcttcctatttgaaccgtcccgattcaactcgcgactgatggcgcctacaaatag

SEQ ID NO: 1625 - DNA, 77 bp, Pantoea stewartii subsp. stewartii DC283
  misc_feature (1)..(77): AHIE01000030.1/174482-174406 Pantoea stewartii subsp. stewartii DC283 WGS_Sequence30, whole genome shotgun sequence
cctgcgcaaggtgatggcgttccaccttccccaaccgccagcaggtttcccctgcggctgatgacgcctgacactat

SEQ ID NO: 1626 - DNA, 72 bp, Enterococcus rivorum strain LMG 25899 25
  misc_feature (1)..(72): MIEK01000018.1/16817-16746 Enterococcus rivorum strain LMG 25899 25, whole genome shotgun sequence
taatctgagggcgatggtgttcgccgataactatttattgaataacaatagattaatgacgcctattgaagg

SEQ ID NO: 1627 - DNA, 75 bp, Chitinophaga sancti strain DSM 784
  misc_feature (1)..(75): FPIZ01000003.1/253946-253872 Chitinophaga sancti strain DSM 784 genome assembly, contig: LX65DRAFT_scaffold00003.3
tcagaaccaggaaatggtgtcttcctgcacaagaactgtcccgtattcttcgggtctgatggcgcctacaaatag

SEQ ID NO: 1628 - DNA, 67 bp, Vibrio genomosp. F6 str. FF-238
  misc_feature (1)..(67): AJYW02000195.1/134-200 Vibrio genomosp. F6 str. FF-238 FF-238_contig_43, whole genome shotgun sequence
tctagctcaggtgatggatttccacctttaaccgctcaattaatgagataatgattcctactataac

SEQ ID NO: 1629 - DNA, 83 bp, Nostoc sp. PCC 7524
  misc_feature (1)..(83): CP003552.1/6414284-6414366 Nostoc sp. PCC 7524, complete genome
ataattaatggcgatggagctcgccaaaaccgctattccagtgaaaagattgcatctggaaggctgatggctcctactttcct

SEQ ID NO: 1630 - DNA, 103 bp, Candidate division KSB1 bacterium RBG_16_48_16
  misc_feature (1)..(103): METF01000325.1/19416-19314 Candidate division KSB1 bacterium RBG_16_48_16 RBG_16_scaffold_9849, whole genome shotgun sequence
cattcttttggcgatggagttcgccgcaactatctataccgacttttctcagcagaggtactctctgcactagtcggagaagattgatgactcctatttttaa

SEQ ID NO: 1631 - DNA, 74 bp, Planctomycetes bacterium RBG_13_44_8b
  misc_feature (1)..(74): MHYC01000027.1/2940-3013 Planctomycetes bacterium RBG_13_44_8b RBG_13_scaffold_16883, whole genome shotgun sequence
agataaggcggtgatgaggttcaccaaataaccgcccttaaaataataatagggatgataacctctactgacag

SEQ ID NO: 1632 - DNA, 77 bp, Clostridium sp. CAG:230
  misc_feature (1)..(77): FR881878.1/30693-30617 Clostridium sp. CAG:230 genomic scaffold, scf242
gataaaaaagggaatgaagttctcccatagtaatgatactaaaaccgcttatataagctgatgacttctgcattttt

SEQ ID NO: 1633 - DNA, 70 bp, Rufibacter sp. DG31D
  misc_feature (1)..(70): CP010777.1/1638732-1638801 Rufibacter sp. DG31D, complete genome
tttggcccgggtgatggggtaccaccaattcaaccgcctctttgcaaaggctgatgactcctacatgggt

SEQ ID NO: 1634 - DNA, 61 bp, Bacillus bataviensis LMG 21833
  misc_feature (1)..(61): AJLS01000043.1/12129-12069 Bacillus bataviensis LMG 21833 contig43, whole genome shotgun sequence
taaaaaattgacgatggagttcgccataaccgtcctagtgattaatgactcctaccagtgg

SEQ ID NO: 1635 - DNA, 71 bp, Bordetella sp. N genome
  misc_feature (1)..(71): CP013111.1/1761328-1761398 Bordetella sp. N genome
tcacgccctggagatggtgttcctccattaaccaccgcgcgctaaacgcggttgatgacgcctacagaaac

SEQ ID NO: 1636 - DNA, 69 bp, Deltaproteobacteria bacterium GWC2_65_14
  misc_feature (1)..(69): MGPV01000057.1/12406-12338 Deltaproteobacteria bacterium GWC2_65_14 gwc2_scaffold_6009, whole genome shotgun sequence
ccgaaccagggcgatggagttcgcccggaaccgcctgtcgaacggacggctgatgactcctgcttgcgc

SEQ ID NO: 1637 - DNA, 86 bp, Pleurocapsa sp. PCC 7327
  misc_feature (1)..(86): CP003590.1/2938298-2938383 Pleurocapsa sp. PCC 7327, complete genome
agagacgacggcgatggagctcgccgaaaccgcccagcgttttgagcattatcacaacgtatttggctgatggctcctactgttcc

SEQ ID NO: 1638 - DNA, 60 bp, Thermoanaerobacter pseudethanolicus ATCC 33223
  misc_feature (1)..(60): CP000924.1/673881-673940 Thermoanaerobacter pseudethanolicus ATCC 33223, complete genome
ttaaataacggtgatgaagctcaccttattgccgtgaaggctaatggcttctacgcgctt

SEQ ID NO: 1639 - DNA, 63 bp, Methylosinus sp. 3S-1
  misc_feature (1)..(63): LXWX01000002.1/30496-30558 Methylosinus sp. 3S-1 3S1contig10, whole genome shotgun sequence
tccgcgccaggggatggggtgccccctctaaccgccgaagaggctgatgactcctgtcggatt

SEQ ID NO: 1640 - DNA, 88 bp, Kushneria marisflavi strain SW32
  misc_feature (1)..(88): CP021358.1/2600117-2600204 Kushneria marisflavi strain SW32, complete genome
ttttccaaaggagatggcatgcctcccgaagcatgtgcttcgaaccatcgcgttctgacacgtcgtgattgatgatgcctgcaacgcc

SEQ ID NO: 1641 - DNA, 84 bp, Meiothermus silvanus DSM 9946
  misc_feature (1)..(84): CP002042.1/2809184-2809267 Meiothermus silvanus DSM 9946, complete genome
tgaactcgaggcgatggagctcgccataaccgccttccagaagggccgctgacacccgctgaggctgatagctcctacccaagg

SEQ ID NO: 1642 - DNA, 74 bp, Terrisporobacter sp. 08-306576
  misc_feature (1)..(74): JWHR01000142.1/307-380 Terrisporobacter sp. 08-306576 Contig142, whole genome shotgun sequence
taaaaacacgggaatgaagttctcccaaagtatttacttaaaccgcattttatgctgatgacttctgtgattat

SEQ ID NO: 1643 - DNA, 58 bp, Desulfotomaculum acetoxidans DSM 771
  misc_feature (1)..(58): CP001720.1/2876469-2876412 Desulfotomaculum acetoxidans DSM 771, complete genome
aaaatgtatggcgatggagctcgcctaatgctgttaagctgatggctcctaccaggac

SEQ ID NO: 1644 - DNA, 74 bp, Vibrio cincinnatiensis DSM 19608
  misc_feature (1)..(74): FUXB01000012.1/96728-96655 Vibrio cincinnatiensis DSM 19608 genome assembly, contig: BS67DRAFT_scaffold00012.12
ctcaattatggtgatgatgttccaccaagcacgttgtgctaaaccgctttaaagctgatgacgtctgtatatat

SEQ ID NO: 1645 - DNA, 60 bp, Bacillus ginsengihumi strain M2.11
  misc_feature (1)..(60): JRUN01000024.1/7367-7308 Bacillus ginsengihumi strain M2.11 NODE_24, whole genome shotgun sequence
cataattgcggcgatggagttcgcctttaactgctttaagctgatgactcctacctttaa

SEQ ID NO: 1646 - DNA, 60 bp, Peptoniphilus duerdenii ATCC BAA-1640
  misc_feature (1)..(60): GL397071.1/909736-909677 Peptoniphilus duerdenii ATCC BAA-1640 genomic scaffold SCAFFOLD1, whole genome shotgun sequence
aatattatagggaatgaagtactccctttaaacgcgaaagctgatgacttctacttaaat

SEQ ID NO: 1647 - DNA, 65 bp, Methanoregula formicica SMSP
  misc_feature (1)..(65): CP003167.1/709714-709778 Methanoregula formicica SMSP chromosome, complete genome
ttatcatctggtgatgaggtccaccatcaatcgcccggatccgggctgatgacttcttgttttga

SEQ ID NO: 1648 - DNA, 72 bp, Thermoplasmatales archaeon A-plasma
  misc_feature (1)..(72): ATMF01000017.1/70283-70212 Thermoplasmatales archaeon A-plasma AMDU1_APLC00017, whole genome shotgun sequence
tgtagtccgtggaatggcgtttccactaattcaaaccgccggctgaagctggctgatgacgcctgcttgaaa

SEQ ID NO: 1649 - DNA, 83 bp, Betaproteobacteria bacterium RIFCSPLOWO2
  misc_feature (1)..(83): MERD01000069.1/5163-5245 Betaproteobacteria bacterium RIFCSPLOWO2_02_FULL_67_26 rifcsplowo2_02_scaffold_299, whole genome shotgun sequence
gatcccaagggagatggcattcctccacggagtctctgacggagactctcaaccgccgcaaggctgatgatgcctacgtagct

SEQ ID NO: 1650 - DNA, 68 bp, Pseudonocardia sp.
  misc_feature (1)..(68): MEFA01000045.1/7729-7662 Pseudonocardia sp. SCN 72-86 ABS81_C0045, whole genome shotgun sequence
gcccactacggcgatggggctcgccgtcgaccgcccggctcgcccgggctgatagctcctaccaaccg

SEQ ID NO: 1651 - DNA, 83 bp, Gluconacetobacter hansenii ATCC 23769
  misc_feature (1)..(83): CM000920.1/1662506-1662424 Gluconacetobacter hansenii ATCC 23769 chromosome, whole genome shotgun sequence
ctgtcacccggcaatggactctgccaggtgcagccttcacggcgaaccgaaccgccccttgggctgatgattcctacctcgcc

SEQ ID NO: 1652 - DNA, 72 bp, Bifidobacterium scardovii strain LMG 21589
  misc_feature (1)..(72): JGZO01000023.1/39670-39741 Bifidobacterium scardovii strain LMG 21589 Contig23, whole genome shotgun sequence
ttgggatgcggcgatgggacccgcctgaaacttgttttcgaaccgcatcacgctgatagttcctgcacacga

SEQ ID NO: 1653 - DNA, 76 bp, Ruminococcus torques CAG:61
  misc_feature (1)..(76): HF995145.1/6392-6317 Ruminococcus torques CAG:61 genomic scaffold, scf53
tttgactatgggaatgaagttctcccttagtgatgaaactaaaaccgctgatttggctgatgacttctgcattttg

SEQ ID NO: 1654 - DNA, 63 bp, Truepera radiovictrix DSM 17093
  misc_feature (1)..(63): CP002049.1/1696664-1696726 Truepera radiovictrix DSM 17093, complete genome
aacggtcgtggcgatgggtcccgccctcaaccgcccctcgaggctgatggtccctacgtcgtt

SEQ ID NO: 1655 - DNA, 72 bp, Clostridiales bacterium S5-A11
  misc_feature (1)..(72): JRMZ01000009.1/53591-53662 Clostridiales bacterium S5-A11 contig009, whole genome shotgun sequence
agtatgaaagggaatgaagttctcccttgggtaacctaaaccgtttattaagctgatgacttctacaattac

SEQ ID NO: 1656 - DNA, 73 bp, Clostridium sp. CAG:307
  misc_feature (1)..(73): FR898699.1/5701-5629 Clostridium sp. CAG:307 genomic scaffold, scf76
taataaccaggaaatgatgttcttccttgttttataacaaaaccgcaattatgctgatgacgtctatagtttt

SEQ ID NO: 1657 - DNA, 73 bp, Clostridium sp. Maddingley MBC34-26
  misc_feature (1)..(73): ALXI01000102.1/18824-18896 Clostridium sp. Maddingley MBC34-26 contig_203_1, whole genome shotgun sequence
ataaatattgggaatgaagtactcccgtggtttatacctaaaacgctaacaagctaatgacttctgtgatgtt

SEQ ID NO: 1658 - DNA, 98 bp, Oscillatoriales cyanobacterium JSC-12
  misc_feature (1)..(98): CM001633.1/2375952-2375855 Oscillatoriales cyanobacterium JSC-12 chromosome, whole genome shotgun sequence
ctggactatggcaatggagcttgccacaaccgccattggatcttgacatgccctcaactgggttgccaacgtcgatggatgatggctcctactttccc

SEQ ID NO: 1659 - DNA, 60 bp, Thermobacillus composti KWC4
  misc_feature (1)..(60): CP003255.1/3702362-3702421 Thermobacillus composti KWC4, complete genome
gatgaaataggcgatggagttcgccataactgccgaaaggctgatgactcctacccgtgt

SEQ ID NO: 1660 - DNA, 74 bp, Vibrio metschnikovii CIP 69.14 VIB
  misc_feature (1)..(74): ACZO01000002.1/5807-5880 Vibrio metschnikovii CIP 69.14 VIB.Contig139, whole genome shotgun sequence
atgcggctaggtgatgatgttccacctagcagttatgctaaaccgcttttcaagctgatgacgtctgtacatgc

SEQ ID NO: 1661 - DNA, 77 bp, Mycobacterium sherrisii strain BC1_M4
  misc_feature (1)..(77): MIHC01000025.1/12748-12672 Mycobacterium sherrisii strain BC1_M4 PROKKA_contig000025, whole genome shotgun sequence
actgacatcggcgatggagtccgccggaaagctttgctttcgaaccgccgcataaggctgatggcgcctgcgaaccg

SEQ ID NO: 1662 - DNA, 70 bp, Nitrospirae bacterium RBG_16_43_8
  misc_feature (1)..(70): MHEJ01000036.1/13287-13356 Nitrospirae bacterium RBG_16_43_8 RBG_16_scaffold_21261, whole genome shotgun sequence
tttagtatcggcgatggagttcgccattaaccgccccgatcttatcgggactgatgactcctactctcag

SEQ ID NO: 1663 - DNA, 59 bp, [Clostridium] purinilyticum strain DSM 1384
  misc_feature (1)..(59): LGSS01000006.1/104041-104099 [Clostridium] purinilyticum strain DSM 1384 CLPU_6c, whole genome shotgun sequence
cttaataatggtgatggagttcaccagaatcgctgaatgctaatgactcctacaagaaa

SEQ ID NO: 1664 - DNA, 66 bp, Candidimonas nitroreducens strain SC-089
  misc_feature (1)..(66): NJIH01000001.1/175757-175692 Candidimonas nitroreducens strain SC-089 Scaffold1_1, whole genome shotgun sequence
gcgcgcaacggagatggcattcctccttgaaccgccggtacgccggctgatgatgcctacaggttt

SEQ ID NO: 1665 - DNA, 65 bp, Lactobacillus fabifermentans T30PCM01
  misc_feature (1)..(65): KK036467.1/145049-144985 Lactobacillus fabifermentans T30PCM01 genomic scaffold scaffold13, whole genome shotgun sequence
aaattaaatggcgatgacgttcgccgcaaataattgttgatcaatttgatgacgtctactacaaa

SEQ ID NO: 1666 - DNA, 77 bp, Candidatus Burkholderia verschuerenii strain UZHbot4
  misc_feature (1)..(77): LFJJ01000312.1/124-200 Candidatus Burkholderia verschuerenii strain UZHbot4 BVERctg319, whole genome shotgun sequence
ttgtcgataggagatggcattctcctgagggtctcccgctaaccgctcctcgataagccgatgatgcctacccacac

SEQ ID NO: 1667 - DNA, 64 bp, Kaistia sp.
  misc_feature (1)..(64): MEDI01000593.1/8694-8631 Kaistia sp. SCN 65-12 ABS35_C0593, whole genome shotgun sequence
cagcgggatggtgatgggctccaccttcaaccgcctgttctgggctgatgatccctacgcaaca

SEQ ID NO: 1668 - DNA, 63 bp, Geobacillus sp. CAMR12739
  misc_feature (1)..(63): JHUR01000048.1/115196-115134 Geobacillus sp. CAMR12739 Contig48, whole genome shotgun sequence
aatcgaataggcgatggagttcgccataaccgccggcttccggctgatgactcctgctgcgtg

SEQ ID NO: 1669 - DNA, 61 bp, Paenibacillus sabinae T27
  misc_feature (1)..(61): CP004078.1/511381-511441 Paenibacillus sabinae T27, complete genome
ttcatacagggcgatggagttcgcctttaaccgccgcaaggctgatgactcctaccagagg

SEQ ID NO: 1670 - DNA, 65 bp, Leeuwenhoekiella blandensis MED217 s
  misc_feature (1)..(65): CH672395.1/2226-2162 Leeuwenhoekiella blandensis MED217 scf_1099517004314 genomic scaffold, whole genome shotgun sequence
tcaatcacaggcaatgaggtctgcctcaaaccgcttcttagcaagctgatgacttctacttaacc

SEQ ID NO: 1671 - DNA, 69 bp, Pantoea sp. At-9b
  misc_feature (1)..(69): CP002433.1/1819207-1819139 Pantoea sp. At-9b, complete genome
cgctaacaaggtgatggcgttccaccttacccaaccgccccattaagggctgatgacgcctgatatgac

SEQ ID NO: 1672 - DNA, 74 bp, Mollicutes bacterium
  misc_feature (1)..(74): JRFF01000026.1/33643-33716 Mollicutes bacterium HR2 KQ78_contig000026, whole genome shotgun sequence
ataatatttgggaatgatgttctcccttagttaattctaaaaccgcatttagtgctgatgacttctacctatat

SEQ ID NO: 1673 - DNA, 70 bp, Acetobacterium wieringae strain DSM 1911
  misc_feature (1)..(70): LKEU01000030.1/118781-118850 Acetobacterium wieringae strain DSM 1911 ACWI_contig000030, whole genome shotgun sequence
tataaaacaggtgatgaagttcgccctggcaaccgccaaaatgcgttaagctgatgacttctgttaaaat

SEQ ID NO: 1674 - DNA, 67 bp, Solirubrobacterales bacterium 70-9
  misc_feature (1)..(67): MKSH01000238.1/6276-6342 Solirubrobacterales bacterium 70-9 SCNpilot_bf_inoc_scaffold_5980, whole genome shotgun sequence
cgccgtggtggcgatgaggctcgccgtaaccgccgtgaagctcgcggctgatggcctctacggaagt

SEQ ID NO: 1675 - DNA, 63 bp, Pseudomonas aeruginosa PAO1
  misc_feature (1)..(63): >AE004091.2/4914637-4914575 Pseudomonas aeruginosa PAO1, complete genome
ttgccgacaggagatggcattcctccttcaaccgcccctggggctgatgatgcctacgcatga

SEQ ID NO: 1676 - DNA, 67 bp, [Clostridium] paradoxum JW-YL-7
  misc_feature (1)..(67): LSFY01000001.1/775110-775044 [Clostridium] paradoxum JW-YL-7 = DSM 7308 strain JW-YL-7 ctg1, whole genome shotgun sequence
attagtttaggtgatggagttcgcctttaaccattgcgtctttgcaattaatgactcctacttagaa

SEQ ID NO: 1677 - DNA, 78 bp, Candidatus Burkholderia brachyanthoides strain UZHbot7
  misc_feature (1)..(78): LFJI01000454.1/683-606 Candidatus Burkholderia brachyanthoides strain UZHbot7 BRCHctg457, whole genome shotgun sequence
ttgtggatagaaaatggcattctcctgtggttctcccgcttaaccgctcctcgatgagccgatgatgcctacacacac

SEQ ID NO: 1678 - DNA, 67 bp, Acinetobacter sp. 39-4
  misc_feature (1)..(67): MKRP01000098.1/535-469 Acinetobacter sp. 39-4 SCNpilot_BF_INOC_scaffold_12059, whole genome shotgun sequence
tagagaaaaggagatggcattcctcctattgcaaaccgccgttttggctaatgatgcctacgttacc

SEQ ID NO: 1679 - DNA, 63 bp, Mesorhizobium sp. Root157
  misc_feature (1)..(63): LMGJ01000004.1/88871-88809 Mesorhizobium sp. Root157 contig_12, whole genome shotgun sequence
agccgcgatggggatggagttcccccgaaactgcccgcaagggctgatgactcctaccgcaac

SEQ ID NO: 1680 - DNA, 69 bp, Chishuiella changwenlii strain DSM 27989
  misc_feature (1)..(69): FRBH01000007.1/124440-124508 Chishuiella changwenlii strain DSM 27989 genome assembly, contig: Ga0131172_107
aacaaaataggaaatggtgttcttcctaaaccaaaccgctttataatagctgatgacgcctgattatta

SEQ ID NO: 1681 - DNA, 72 bp, Duganella sp. Leaf126
  misc_feature (1)..(72): LMNW01000031.1/376710-376781 Duganella sp. Leaf126 contig_4, whole genome shotgun sequence
ctgagcatgggagatggcattcctcctgcaactatcccaaccgccgctccggctgatgatgcctgctgattc

SEQ ID NO: 1682 - DNA, 70 bp, Bacteroidia bacterium 44-10
  misc_feature (1)..(70): MKTE01000074.1/12152-12083 Bacteroidia bacterium 44-10 SCNpilot_bf_inoc_scaffold_454, whole genome shotgun sequence
gatcataaagggaatgggacttccctgttataaaccgctaccatacatagctgatagttcctacttaact

SEQ ID NO: 1683 - DNA, 69 bp, Nitrospirae bacterium RBG_13_43_8
  misc_feature (1)..(69): MHEH01000185.1/1598-1666 Nitrospirae bacterium RBG_13_43_8 RBG_13_scaffold_6510, whole genome shotgun sequence
taaacaactggcgatggggttcgccattaaccgtccttaaaattaaggaatgataacccctactgggac

SEQ ID NO: 1684 - DNA, 87 bp, Granulicella rosea strain DSM 18704
  misc_feature (1)..(87): FZOU01000002.1/249716-249630 Granulicella rosea strain DSM 18704 genome assembly, contig: Ga0111638_102
ataattcaaggtgatggggttccaccgcacaaccgcccagtttttcggcaacgagccaaagacgaagctgatgactcctacgatttg

SEQ ID NO: 1685 - DNA, 74 bp, Hymenobacter psychrotolerans DSM 18569
  misc_feature (1)..(74): FRAS01000007.1/92672-92745 Hymenobacter psychrotolerans DSM 18569 genome assembly, contig: EJ61DRAFT_scaffold00007.7
tgcgcatacggtgatggatttccaccgcgaaccgccgaagcttcgtgctttgcgctgatgattcctactgagcg

SEQ ID NO: 1686 - DNA, 77 bp, Eubacterium biforme DSM 3989
  misc_feature (1)..(77): DS996844.1/92835-92759 Eubacterium biforme DSM 3989 Scfld8 genomic scaffold, whole genome shotgun sequence
aatctttttgggaatgaagttctcccttagtttaaaactaaaaccgctttttataggctgatgacttctgtgttttt

SEQ ID NO: 1687 - DNA, 66 bp, Vibrio tubiashii ATCC 19109
atttcccaaggtgatggggttccacctacttaaccgccaattctggctgatgactcctacagatac

SEQ ID NO: 1688 - DNA, 77 bp, Arthrobacter sp. Soil782
  misc_feature (1)..(77): LMSO01000011.1/147408-147332 Arthrobacter sp. Soil782 contig_6, whole genome shotgun sequence
gtcgaatccggcgatggatcccgccgggacccacttgggtccgaaccgccgcagtggctgatggttcctgccttcga

SEQ ID NO: 1689 - DNA, 66 bp, Pedobacter sp. BMA
  misc_feature (1)..(66): LECU01000009.1/160315-160250 Pedobacter sp. BMA contig09, whole genome shotgun sequence
ttgacttacggaaatggtgtccttccgattcaaccgcttttcaaagctgatggcgcctgcaaagta

SEQ ID NO: 1690 - DNA, 100 bp, Candidatus Melainabacteria bacterium RIFOXYA2
  misc_feature (1)..(100): MFRQ01000032.1/11321-11222 Candidatus Melainabacteria bacterium RIFOXYA2_FULL_32_9 rifoxya2_full_scaffold_1691, whole genome shotgun sequence
ttaaatttaggtgatgaggctcgccagtgttcgcaagaaccgaactgccagaataagtgggtaatgctcgctttaatgggctgatagcttctacttcatt

SEQ ID NO: 1691 - DNA, 73 bp, Corchorus capsularis cultivar CVL-1
  misc_feature (1)..(73): AWWV01005986.1/4472-4400 Corchorus capsularis cultivar CVL-1 contig06004, whole genome shotgun sequence
tgcgcgcttggagatggcgttcctcctgggaaaccgaaccgcagcattcgctgccgatgacgcctacagttac

SEQ ID NO: 1692 - DNA, 60 bp, Anoxybacillus amylolyticus strain DSM 15939
  misc_feature (1)..(60): CP015438.1/1600163-1600222 Anoxybacillus amylolyticus strain DSM 15939, complete genome
acttgaataggcgatggagttcgccataattgccggaaggctgatgactcctaccagttg

SEQ ID NO: 1693 - DNA, 62 bp, Candidatus Wallbacteria bacterium GWC2_49_35
  misc_feature (1)..(62): MGFH01000188.1/16403-16464 Candidatus Wallbacteria bacterium GWC2_49_35 gwc2_scaffold_4870, whole genome shotgun sequence
tgaaataatggcgatggagttcgccaataaccgcattttgtgctgatgactcctactttttg

SEQ ID NO: 1694 - DNA, 65 bp, Burkholderia sp. TJI49
  misc_feature (1)..(65): AEXE01000085.1/1430-1366 Burkholderia sp. TJI49 contig072.1, whole genome shotgun sequence
ttgaacccaggagatggcattcctcccgacaaccgcccttcggggctaatgatgcctacaggcct

SEQ ID NO: 1695 - DNA, 62 bp, Rhizobiales bacterium 62-17
  misc_feature (1)..(62): MKVW01000001.1/773297-773358 Rhizobiales bacterium 62-17 SCNpilot_cont_300_bf_scaffold_105, whole genome shotgun sequence
cgtagcgatggggatggagttccccgatacccgccgcgaaggctgatgactcctactgcgac

SEQ ID NO: 1696 - DNA, 74 bp, Clostridiales bacterium 42_27
  misc_feature (1)..(74): MNRF01000414.1/23270-23343 Clostridiales bacterium 42_27 Ley3_66761_scaffold_1716, whole genome shotgun sequence
tgcgcaatcgggaatgaggttctcccacggcactgccgaaaccgcttttttgagctgatgacttctgtgatttt

SEQ ID NO: 1697 - DNA, 74 bp, Mycobacterium kansasii 732 g
  misc_feature (1)..(74): JANZ01000004.1/78261-78188 Mycobacterium kansasii 732 gmk732.contig.3, whole genome shotgun sequence
cgactgactggcgatggtgcccgcccggaagacgacttccgaaccgccacaaggctgatggcccctgcgaacga

SEQ ID NO: 1698 - DNA, 62 bp, Mesorhizobium amorphae CCNWGS0123
  misc_feature (1)..(62): AGSN01000124.1/10893-10954 Mesorhizobium amorphae CCNWGS0123 contig00132, whole genome shotgun sequence
atagcgctcgggaatggtgtctccctgaaaaccgcgctgatgctgatgacgcctactgacga

SEQ ID NO: 1699 - DNA, 71 bp, Sphingobium baderi LL03; identical to SEQ ID NO: 210
  misc_feature (1)..(71): ATIB01000027.1/93607-93537 Sphingobium baderi LL03 contig027, whole genome shotgun sequence

SEQ ID NO: 1700 - DNA, 75 bp, Corchorus olitorius cultivar O-4; identical to SEQ ID NO: 217
  misc_feature (1)..(75): AWUE01004991.1/274-200 Corchorus olitorius cultivar O-4 contig05010, whole genome shotgun sequence

SEQ ID NO: 1701 - DNA, 79 bp, Caulobacterales bacterium 68-7
  misc_feature (1)..(79): MKRI01000013.1/30949-31027 Caulobacterales bacterium 68-7 SCNpilot_cont_300_bf_scaffold_1229, whole genome shotgun sequence
ccccgcctcggcgatggatttccgcctggcgtcatgccgaaccgctcctcgggaaggagccgatgattcctactttgac

SEQ ID NO: 1702 - DNA, 59 bp, Turicibacter sp. H121
  misc_feature (1)..(59): CP013476.1/1492496-1492438 Turicibacter sp. H121, complete genome
tattgaataggcgatggagttcgccattaaccgcgaaagctaatgactcctactcttta

SEQ ID NO: 1703 - DNA, 63 bp, Arachidicoccus sp. BS20
  misc_feature (1)..(63): CP015971.1/1423680-1423742 Arachidicoccus sp. BS20, complete genome
atcgcaaaaggaaatggtgtcttccttctccaaccgctaaaagctgatggcgcctacaaattt

SEQ ID NO: 1704 - DNA, 63 bp, Serratia odorifera DSM 4582
  misc_feature (1)..(63): GG753567.1/57762-57824 Serratia odorifera DSM 4582 genomic scaffold SCAFFOLD1, whole genome shotgun sequence
tcttcccttggagatggcattcctccataaccgcccttaccggctgatgatgcctacgttacc

SEQ ID NO: 1705 - DNA, 72 bp, Triticum urartu cultivar G1812
  misc_feature (1)..(72): AOTI010848925.1/18020-17949 Triticum urartu cultivar G1812 contig848926, whole genome shotgun sequence
ctctattaaggtgatggtgctccacctttctcaaccgccaaaattctcttggatgatgacgcctgatatata

SEQ ID NO: 1706 - DNA, 75 bp, Plautia stali symbiont
  misc_feature (1)..(75): AP012551.1/3160364-3160290 Plautia stali symbiont DNA, complete genome
tgcctctgaggtgatggcgtgccaccttacccaaccgccctcaggtcacagacggctgatgacgcctgacaactt

SEQ ID NO: 1707 - DNA, 68 bp, Enterococcus mundtii QU 25
  misc_feature (1)..(68): AP013036.1/1991234-1991167 Enterococcus mundtii QU 25 DNA, complete genome
aaatgaataggtgatggtgttcgcctttaaatgtcgatcgatagatgactaatgacgcctactaaaaa

SEQ ID NO: 1708 - DNA, 62 bp, Methylobacterium radiotolerans JCM 2831
  misc_feature (1)..(62): CP001001.1/4759637-4759698 Methylobacterium radiotolerans JCM 2831, complete genome
cgtcccgatggggatggagttccccgaaaccgcccgtcagggctgatgactcctaccgcgaa

SEQ ID NO: 1709 - DNA, 75 bp, Escherichia coli ISC11,
  misc_feature (1)..(75): CBWP010000050.1/12734-12660 Escherichia coli ISC11, WGS project CBWP01000000 data, contig: c64
gatttacaaggtgatggtgctccacctttcccaaccgccggtttttcaacaccggatgatggcgcctgatataca

SEQ ID NO: 1710 - DNA, 69 bp, Flavobacteriaceae bacterium CG2_30_31_66
  misc_feature (1)..(69): MNYM01000024.1/77452-77520 Flavobacteriaceae bacterium CG2_30_31_66 cg2_3.0_scaffold_84_c, whole genome shotgun sequence
atttaagaaggaaatggtgtccttccttttctaaccgcttttttaaaagctgatgacgcctgattaagc

SEQ ID NO: 1711 - DNA, 68 bp, Sporolactobacillus laevolacticus DSM 442
  misc_feature (1)..(68): AWTC01000004.1/68382-68315 Sporolactobacillus laevolacticus DSM 442 Contig004, whole genome shotgun sequence
tagtaaataggcgatgacgttcgccttcaaccgctgtactagaatcagctaataacgtctaccttgat

SEQ ID NO: 1712 - DNA, 59 bp, Sporobacter termitidis DSM 10068
  misc_feature (1)..(59): FQXV01000011.1/100368-100426 Sporobacter termitidis DSM 10068 genome assembly, contig: EK05DRAFT_scaffold00011.11
aaaacgacaagcgatggagttcgctttaaatgcttctggctgatgactcctacaaacgg

SEQ ID NO: 1713 - DNA, 64 bp, Methanobacterium sp. MB1
  misc_feature (1)..(64): HG425166.1/734874-734937 Methanobacterium sp. MB1 complete sequence
tctattgctggtgatggggttcaccattaaccgcctatccaaggctgatgactcctagaaacta

SEQ ID NO: 1714 - DNA, 63 bp, Enterococcus saccharolyticus ATCC 43076
  misc_feature (1)..(63): KE136389.1/620807-620745 Enterococcus saccharolyticus ATCC 43076 genomic scaffold acpML-supercont1.1, whole genome shotgun sequence
tttgggcatagggatggtgctcccctataaccgccagaaatggctgatggcgcctgttatata

SEQ ID NO: 1715 - DNA, 72 bp, Clostridium sp. CAG:299
  misc_feature (1)..(72): FR894469.1/6216-6145 Clostridium sp. CAG:299 genomic scaffold, scf326
ataaaactagggaatgaagttctcccatggcaagccaaaaccgctgatagagctgatgacttctgtgacaac

SEQ ID NO: 1716 - DNA, 77 bp, Sphingomonas taxi strain ATCC 55669
  misc_feature (1)..(77): CP009573.1/2691-2767 Sphingomonas taxi strain ATCC 55669 plasmid STP2, complete sequence
ctcgggcacggcgatggatttccgccgggccattcggccgaaccgccctcgcaagggccgatgattcctaccaagcg

SEQ ID NO: 1717 - DNA, 68 bp, Nitrosovibrio sp. Nv17
  misc_feature (1)..(68): FPIQ01000006.1/72610-72543 Nitrosovibrio sp. Nv17 genome assembly, contig: Ga0111729_106
ttcccccacggagatggcatgcctccgacaaccgccgcgcccgcgcggctgatgatgcctacgcaaca

SEQ ID NO: 1718 - DNA, 69 bp, Candidimonas nitroreducens strain SC-089
  misc_feature (1)..(69): NJIH01000001.1/186182-186114 Candidimonas nitroreducens strain SC-089 Scaffold1_1, whole genome shotgun sequence
attgcttacggagatggcattcctccgataaacgccggcgctcagccggatgatgatgcctgcatgatc

SEQ ID NO: 1719 - DNA, 67 bp, Triticum urartu cultivar G1812
  misc_feature (1)..(67): AOTI010641095.1/136-202 Triticum urartu cultivar G1812 contig641096, whole genome shotgun sequence
tcaaaaaaaggaaatggtgttcttccttacccaaccgctttaaaaagctgatgacgcctggttaatc

SEQ ID NO: 1720 - DNA, 89 bp, Arthrobacter sp. AK-YN10
  misc_feature (1)..(89): AVPD02000038.1/13376-13288 Arthrobacter sp. AK-YN10 contig038, whole genome shotgun sequence
tctgttcacggtgatggatcccgccggaacagcccgcacgcgcgtgggcttgttcgaaccgcctcctggctaatggttcctacctttgc

SEQ ID NO: 1721 - DNA, 71 bp, Xanthomonas albilineans GPE PC73
  misc_feature (1)..(71): FP565176.1/1682310-1682380 Xanthomonas albilineans GPE PC73 complete genome
tgcgccgcaggagatggcgttcctcctttaaccaccgtgcgatccgcatggttgatgacgcctacagccgc

SEQ ID NO: 1722 - DNA, 71 bp, Desulfuromonas acetoxidans DSM 684
  misc_feature (1)..(71): AAEW02000001.1/156146-156076 Desulfuromonas acetoxidans DSM 684 ctg66, whole genome shotgun sequence
catgttaacgggaatggagttctcccggtaaccgcctgtcgatttttcaggctgatgactcctgtatgagg

SEQ ID NO: 1723 - DNA, 62 bp, Candidate division Zixibacteria bacterium RBG_16_50_21 ,
  misc_feature (1)..(62): MEWO01000012.1/3987-4048 Candidate division Zixibacteria bacterium RBG_16_50_21 RBG_16_scaffold_16836, whole genome shotgun sequence
agtattaatggcgatggggttcgcctttaaccgcctaaacggctgataactcctaccggtta

SEQ ID NO: 1724 - DNA, 64 bp, Nitrospirae bacterium
  misc_feature (1)..(64): MHEI01000122.1/8060-7997 Nitrospirae bacterium RBG_16_43_11 RBG_16_scaffold_91172, whole genome shotgun sequence
catggagatggtgatggggttcaccttataaccgcctgagaaggctgatgactcctacctgtag

SEQ ID NO: 1725 - DNA, 68 bp, Chryseobacterium sp. Hurlburt 01
  misc_feature (1)..(68): LGIP01000019.1/54203-54270 Chryseobacterium sp. Hurlburt 01 HurlbutContig21, whole genome shotgun sequence
tgtaaacagggaaatggtgttcttccttacccaaccgctttagcaaagctgatgacgcctgattaatt

SEQ ID NO: 1726 - DNA, 65 bp, Clostridia bacterium
  misc_feature (1)..(65): LGEZ01000003.1/9477-9413 Clostridia bacterium 41_269 MPF_scaffold_6, whole genome shotgun sequence
tataaaaaaggcgatggggctcgccagaattacccaaacgaagggttgatggctcctagtttttc

SEQ ID NO: 1727 - DNA, 63 bp, Rhizobiales bacterium
  misc_feature (1)..(63): MKRJ01000017.1/22706-22768 Rhizobiales bacterium 65-79 SCNpilot_cont_1000_bf_scaffold_222, whole genome shotgun sequence
ttcccgtgcggtgatggagttcaccatgtaaccgcccccagggctgatgactcctctgttgct

SEQ ID NO: 1728 - DNA, 75 bp, Flavobacteriia bacterium
  misc_feature (1)..(75): MKVF01000006.1/236977-237051 Flavobacteriia bacterium 40-80 scnpilot_p_inoc_scaffold_14, whole genome shotgun sequence
attaaaaaaggaaatggtgttcttccttacccaaccgtcccgatagctatcggagctgatgacgcctgattaatt

SEQ ID NO: 1729 - DNA, 63 bp, Alicyclobacillus sp.
  misc_feature (1)..(63): MELW01000360.1/7682-7620 Alicyclobacillus sp. RIFOXYA1_FULL_53_8 rifoxya1_full_scaffold_975, whole genome shotgun sequence
aattgcatcggtgatggagctcaccattaaactcctgcaaaggataatggctcctgcgaatag

SEQ ID NO: 1730 - DNA, 65 bp, Candidimonas bauzanensis strain; identical to SEQ ID NO: 1129
  misc_feature (1)..(65): FQXE01000023.1/8211-8275 Candidimonas bauzanensis strain CGMCC 1.10190 genome assembly, contig: Ga0070552_123

SEQ ID NO: 1731 - DNA, 85 bp, Eubacterium sp.
  misc_feature (1)..(85): FR886277.1/3436-3520 Eubacterium sp. CAG:252 genomic scaffold, scf53
acttaaacagggaatgaagttctcccttggaatctggaagcagaaacctagactgcttattatagctgatgacttctacgattat

SEQ ID NO: 1732 - DNA, 61 bp, Desulfovibrio africanus str. Walvis Bay
  misc_feature (1)..(61): CP003221.1/3960656-3960716 Desulfovibrio africanus str. Walvis Bay, complete genome
cgccgcacaggggatggagtcccccttgaaccgccaagttgctgatgactcctactgtcga

SEQ ID NO: 1733 - DNA, 67 bp, Acinetobacter larvae strain BRTC-1
  misc_feature (1)..(67): CP016895.1/890108-890042 Acinetobacter larvae strain BRTC-1 chromosome, complete genome
acattctaaggagatggtattcctccgattacaaaccgcctttttggctaatgatgcctacgttact

SEQ ID NO: 1734 - DNA, 60 bp, Bacillus sp. SGD-V-76
  misc_feature (1)..(60): KQ758640.1/49975-50034 Bacillus sp. SGD-V-76 genomic scaffold Scaffold14, whole genome shotgun sequence
aaaatatacggcgatggagttcgccaaaactgctgcagagctaatgactcctacccatat

SEQ ID NO: 1735 - DNA, 80 bp, Williamsia sterculiae strain CPCC 203464
  misc_feature (1)..(80): FTNT01000006.1/163316-163237 Williamsia sterculiae strain CPCC 203464 genome assembly, contig: Ga0104459_106
agcaggtgcggcgatggatctcgccggatttcctgttcgggaaatcgaaccgcctctcggctgatagttcctgctgatga

SEQ ID NO: 1736 - DNA, 65 bp, Mycobacterium sherrisii strain BC1_M4
  misc_feature (1)..(65): MIHC01000025.1/44643-44579 Mycobacterium sherrisii strain BC1_M4 PROKKA_contig000025, whole genome shotgun sequence
ttagcggtcggcgatgaggctccgcccccttcgcgtcatctgacgctgatggcttctaccccgca

SEQ ID NO: 1737 - DNA, 78 bp, Tardiphaga sp. Vaf07
  misc_feature (1)..(78): LVYV01000014.1/51254-51331 Tardiphaga sp. Vaf07 contig_21, whole genome shotgun sequence
aaacgacacggtaatggattctgccgggccatcgtggccgaaccgcttccgagagaagctgatgactcctactcaact

SEQ ID NO: 1738 - DNA, 72 bp, Candidatus Nitrospira inopinata isolate ENR4
  misc_feature (1)..(72): LN885086.1/39594-39523 Candidatus Nitrospira inopinata isolate ENR4 genome assembly, chromosome: 1
cagagcattggtgatggagttcaccaagaaccgtcccaccgtgaaagcgggactgatgactcctaccgaaga

SEQ ID NO: 1739 - DNA, 62 bp, Propionispora sp. 2/2-37
  misc_feature (1)..(62): CYSP01000003.1/154139-154078 Propionispora sp. 2/2-37 isolate 2/2-37 genome assembly, contig: 2/2_contig3
ctgtatatcggcgatggggttcgccatacataccgtacatcggttatgactcctaccacatc

SEQ ID NO: 1740 - DNA, 79 bp, Bosea sp. 67-29
  misc_feature (1)..(79): MKSQ01000024.1/24728-24650 Bosea sp. 67-29 SCNpilot_expt_1000_bf_scaffold_559, whole genome shotgun sequence
agcgagcccggcaatggattctgcctgagctgttcttcggctcgaaccgcctcggaaggctgatgactcctactcgact

SEQ ID NO: 1741 - DNA, 64 bp, Paraburkholderia phenazinium strain GAS95
  misc_feature (1)..(64): FSRU01000002.1/319558-319495 Paraburkholderia phenazinium strain GAS95 genome assembly, contig: Ga0132017_12
tcgcctgctggagatggcattctcctttaaccgcccagacagggctgatgatgcctgcatgccc

SEQ ID NO: 1742 - DNA, 69 bp, Acinetobacter qingfengensis strain ANC 4671
  misc_feature (1)..(69): MKKK01000021.1/12660-12592 Acinetobacter qingfengensis strain ANC 4671 Contig28, whole genome shotgun sequence
gatccatcgggaaatggcatacttccctatacaaaccgccaattgttggctaatgatgcctacgtaacc

SEQ ID NO: 1743 - DNA, 59 bp, Thermobrachium celere DSM 8682
  misc_feature (1)..(59): HF952018.1/1488085-1488027 Thermobrachium celere DSM 8682 genomic scaffold, scaffold33
aagttaataggcgatggagttcgcctaaatgctgataagctaatgactcctacaaatgt

SEQ ID NO: 1744 - DNA, 63 bp, Thermotoga sp. 50_1627
  misc_feature (1)..(63): LGFH01000009.1/2976-3038 Thermotoga sp. 50_1627 MPF_scaffold_34, whole genome shotgun sequence
aacagttggggcgatggagtccgcccacaagtgcccgtccgggctgatgactcctaccttcgg

SEQ ID NO: 1745 - DNA, 81 bp, Vibrio sp. C7
  misc_feature (1)..(81): BBMQ01000019.1/1678-1758 Vibrio sp. C7 DNA, contig: contig00024, strain: JCM 19233
ccaactcacggagatgatgttcctccatgctaattttttgattagcaaaaccgcttaaacgctgatgacgtctgttaatac

SEQ ID NO: 1746 - DNA, 77 bp, Novosphingobium sp. ST904; identical to SEQ ID NO: 1286
  misc_feature (1)..(77): LGJH01000116.1/18218-18294 Novosphingobium sp. ST904 contig_51, whole genome shotgun sequence

SEQ ID NO: 1747 - DNA, 67 bp, Streptomyces griseofuscus strain NG1-7
  misc_feature (1)..(67): MTKC01000003.1/5829667-5829733 Streptomyces griseofuscus strain NG1-7 NG1-17_1_1, whole genome shotgun sequence
gaggcgtacggcgatgaggctcgccgcaaccgcacccatggccggtgctgatggcctctacgtgatg

SEQ ID NO: 1748 - DNA, 75 bp, Enterococcus hermanniensis strain DSM 17122
  misc_feature (1)..(75): JXKQ01000003.1/71030-71104 Enterococcus hermanniensis strain DSM 17122 Scaffold3, whole genome shotgun sequence
attaaatacgggaatgagtgtctccctaagattttttcttaaaccgctaatcaagctgatgacttctacaaattt

SEQ ID NO: 1749 - DNA, 64 bp, Joostella marina DSM 19592
  misc_feature (1)..(64): JH651379.1/3012680-3012743 Joostella marina DSM 19592 genomic scaffold Joomascaffold_1, whole genome shotgun sequence
atcacatttggcaatgaggtctgcctttaaccgctcaaaatgagctgatgacttctactgataa

SEQ ID NO: 1750 - DNA, 71 bp, Elusimicrobia bacterium
  misc_feature (1)..(71): MGVQ01000022.1/32399-32329 Elusimicrobia bacterium RIFOXYC2_FULL_34_12 rifoxyc2_full_scaffold_1509, whole genome shotgun sequence
taattaactggagatggggttctccgtaaagcgtcccgcttaaaattggggctgatgactcctacttaaac

SEQ ID NO: 1751 - DNA, 66 bp, Acetobacter indonesiensis 5H-1
  misc_feature (1)..(66): BAMW01000022.1/78547-78612 Acetobacter indonesiensis 5H-1 DNA, contig: Abin_022
cgccgcataggggatggggttcccccttataaccgcccgtacagggctgatgactcctgccgttgc

SEQ ID NO: 1752 - DNA, 60 bp, Acetobacterium bakii strain DSM 8239
  misc_feature (1)..(60): LGYO01000007.1/208624-208683 Acetobacterium bakii strain DSM 8239 contig_7, whole genome shotgun sequence
attaacgatggtgatggagttcacccaaattgctacttagctaatgactcctgcaggctt

SEQ ID NO: 1753 - DNA, 69 bp, Paenibacillus bovis strain BD3526
  misc_feature (1)..(69): CP013023.1/4660124-4660056 Paenibacillus bovis strain BD3526, complete genome
aattgaatcggtgatggagttcgccgttaaccgctggcataataatcagctgatgactcctacctgttg

SEQ ID NO: 1754 - DNA, 69 bp, Candidimonas bauzanensis strain CGMCC 1.10190; identical to SEQ ID NO: 1217
  misc_feature (1)..(69): FQXE01000008.1/21421-21489 Candidimonas bauzanensis strain CGMCC 1.10190 genome assembly, contig: Ga0070552_108

SEQ ID NO: 1755 - DNA, 71 bp, Mangrovibacter sp. MFB070
  misc_feature (1)..(71): JJMI01000057.1/53371-53301 Mangrovibacter sp. MFB070 Contig-058, whole genome shotgun sequence
aaagcacaaggtgatggcgttccaccttacccaaccgctccattcagggggctgatgacgcctggcgtaac

SEQ ID NO: 1756 - DNA, 61 bp, Paraburkholderia caribensis strain Bcrs1W
  misc_feature (1)..(61): CP013347.1/2218741-2218801 Paraburkholderia caribensis strain Bcrs1W chromosome 1, complete sequence
gcgcgcgccggagatggcattctcctaaaccgccctcgtggctgatgatgcctgcttcgcc

SEQ ID NO: 1757 - DNA, 71 bp, Tetrasphaera japonica T1-X7
  misc_feature (1)..(71): HF570958.1/3227824-3227894 Tetrasphaera japonica T1-X7 genomic scaffold, 1540_scaffold1
gtggccacaggtgatggaccccacctggggcgaggccccgaaccgcatccgctaatggctcctgcgacgtt

SEQ ID NO: 1758 - DNA, 83 bp, Chroococcidiopsis thermalis PCC 7203
  misc_feature (1)..(83): CP003597.1/2805389-2805307 Chroococcidiopsis thermalis PCC 7203, complete genome
ataatctgaggtgatggggctcgccttaactgccatctggaaattgacatgacaaccagaaggctgatggctcctactgttcc

SEQ ID NO: 1759 - DNA, 88 bp, Stanieria cyanosphaera PCC 7437
  misc_feature (1)..(88): CP003653.1/502946-502859 Stanieria cyanosphaera PCC 7437, complete genome
catagagatggcaatggagcttgccaaaaccgccctttgtttttaagtttttcataatctttaagaggctgatagctcctactcttcc

SEQ ID NO: 1760 - DNA, 61 bp, Paenibacillus macerans strain 8244
  misc_feature (1)..(61): KN125580.1/3295453-3295393 Paenibacillus macerans strain 8244 genomic scaffold scaffold1, whole genome shotgun sequence
agtattaaaggcgatggagttcgcctgaaccgctccccgagctaatgactcctaccagttg

SEQ ID NO: 1761 - DNA, 55 bp, Lactobacillus casei ATCC 334
  misc_feature (1)..(55): CP000423.1/2429871-2429817 Lactobacillus casei ATCC 334, complete genome
aaattaaatggcgatggtgttcgcctatacgcaagttgatgacacctaccttgag

SEQ ID NO: 1762 - DNA, 66 bp, Armatimonadetes bacterium
  misc_feature (1)..(66): MEMZ01000092.1/8658-8723 Armatimonadetes bacterium RBG_16_58_9 RBG_16_scaffold_26212, whole genome shotgun sequence
tcgactaacggggatggagtcccccttgaaaaccgccttggccatgctgatgactcctaccgcgcg

SEQ ID NO: 1763 - DNA, 67 bp, Streptomyces sp. Tu 6176
  misc_feature (1)..(67): KK106988.1/2431965-2431899 Streptomyces sp. Tu 6176 genomic scaffold scaffold00001, whole genome shotgun sequence
acgtgccggggcgatggggctcgcccgtgaccgcacggaccgccgtgctgatggcctctgcgtggac

SEQ ID NO: 1764 - DNA, 73 bp, Betaproteobacteria bacterium
  misc_feature (1)..(73): MEQV01000269.1/15415-15487 Betaproteobacteria bacterium RIFCSPLOWO2_02_FULL_62_17 rifcsplowo2_02_scaffold_6838, whole genome shotgun sequence
aatatcagtggagatggcattcctcccttaaccgcctcacgtttctttcggggctgatgatgcctgcgttagt

SEQ ID NO: 1765 - DNA, 117 bp, Burkholderia sp. Leaf177
  misc_feature (1)..(117): LMPF01000022.1/26482-26598 Burkholderia sp. Leaf177 contig_5, whole genome shotgun sequence
ttgcgctacggagatggcattcctcctgcagctcatcgcaaaccgctggattagttacgtagctgacttatctgattgagtcgcctaattaagccagctaatgatgcctacgcgttc

SEQ ID NO: 1766 - DNA, 73 bp, Acidobacteria bacterium 13_1_20CM_58_21; identical to SEQ ID NO: 699
  misc_feature (1)..(73): MNIJ01000235.1/7576-7504 Acidobacteria bacterium 13_1_20CM_58_21 13_1_20cm_full_scaffold_1091, whole genome shotgun sequence

SEQ ID NO: 1767 - DNA, 64 bp, Streptomyces sp. CB01249
  misc_feature (1)..(64): LISW01000001.1/1383246-1383309 Streptomyces sp. CB01249 scaffold1, whole genome shotgun sequence
atggcgaacggcgatgaggcccgccataaccgcggaattccccgctgacggtctctgtttcttg

SEQ ID NO: 1768 - DNA, 61 bp, Lactobacillus crispatus ST1
  misc_feature (1)..(61): FN692037.1/1065514-1065574 Lactobacillus crispatus ST1 complete genome, strain ST1
aactgaataggtgatgacgttcgccattaaccgagtaaaatctaatgacgtctactttatc

SEQ ID NO: 1769 - DNA, 83 bp, Armatimonadetes bacterium CG2_30_66_41
  misc_feature (1)..(83): MNXN01000067.1/6742-6660 Armatimonadetes bacterium CG2_30_66_41 cg2_3.0_scaffold_16220_c, whole genome shotgun sequence
ctgactttcggcgatggagttcgccggctccggttttcaggctggagcgaactgttcggaacgctgatgactcctgaccagta

SEQ ID NO: 1770 - DNA, 80 bp, Frateuria sp. Soil773
  misc_feature (1)..(80): LMSL01000040.1/145353-145274 Frateuria sp. Soil773 contig_8, whole genome shotgun sequence
tgtacgcttggagatggcattcctccgccctcggcgttccggggggaaccgccattgtggccgatgatgcctgctcgttt

SEQ ID NO: 1771 - DNA, 64 bp, Deltaproteobacteria bacterium RBG_16_54_11
  misc_feature (1)..(64): MGQS01000118.1/1171-1108 Deltaproteobacteria bacterium RBG_16_54_11 RBG_16_scaffold_68799, whole genome shotgun sequence
attgttattggtgatggagttcgccataaccgccctcaagagggctgatgactcctatcttgaa

SEQ ID NO: 1772 - DNA, 74 bp, Planctomycetaceae bacterium SCGC AG-212-F19
  misc_feature (1)..(74): LSTD01000273.1/5338-5265 Planctomycetaceae bacterium SCGC AG-212-F19 AG-212-F19.6, whole genome shotgun sequence
tacggaaaaggcgatggagttcgccataaccgcgcggttccgaaggagccgttgctgataactcctaccgcgag

SEQ ID NO: 1773 - DNA, 63 bp, Alicyclobacillus acidocaldarius subsp. acidocaldarius DSM 446
  misc_feature (1)..(63): CP001727.1/264912-264974 Alicyclobacillus acidocaldarius subsp. acidocaldarius DSM 446, complete genome
cagtatgtcggtgatggagctcaccggaaccgcccacgacgggctgatggctcctgcgatgca

SEQ ID NO: 1774 - DNA, 89 bp, Natronolimnobius baerhuensis strain CGMCC 1.3597 ZB100002
  misc_feature (1)..(89): MWPH01000003.1/579874-579786 Natronolimnobius baerhuensis strain CGMCC 1.3597 ZB100002, whole genome shotgun sequence
acgtattcgggcgatggggcccgcctgacccaactgccgctctcggcgaccgacacccctcgagcgtggctgacggtccctgccttcaa

SEQ ID NO: 1775 - DNA, 66 bp, Mucilaginibacter pedocola strain TBZ30
  misc_feature (1)..(66): MBTF01000001.1/592373-592438 Mucilaginibacter pedocola strain TBZ30 scaffold1, whole genome shotgun sequence
gatttaaacggaaatggtgtcttccgttcaaaataaccgcctcgtgctgatgacgcctacaattat

SEQ ID NO: 1776 - DNA, 62 bp, Rhizobiales bacterium 63-22
  misc_feature (1)..(62): MKVZ01000012.1/35950-36011 Rhizobiales bacterium 63-22 SCNpilot_cont_500_bf_scaffold_404, whole genome shotgun sequence
ttgtcgcaaggtgatggagttcacctttaactgccttcgaggctgatgactcctgtttcgcc

SEQ ID NO: 1777 - DNA, 63 bp, Sporomusa sphaeroides DSM 2875
  misc_feature (1)..(63): LSLJ01000003.1/352869-352931 Sporomusa sphaeroides DSM 2875 SPSPH_contig000003, whole genome shotgun sequence
ttgaatagcggcgatggagttcgccctgaatcccgtgcaaacggtaatgactcctaccacata

SEQ ID NO: 1778 - DNA, 64 bp, Vibrio variabilis
  misc_feature (1)..(64): BBMS01000037.1/42981-43044 Vibrio variabilis DNA, contig: contig00037, strain: JCM 19239
taccaccaaggtgatggggttccacctacttaaccgccatttggctgatgactcctacagtttc

SEQ ID NO: 1779 - DNA, 69 bp, Burkholderia glumae BGR1
  misc_feature (1)..(69): CP001504.2/2120579-2120511 Burkholderia glumae BGR1 chromosome 2, complete sequence
ccgcgctgcggagatggcatgcctccgcccccaaccgccgctcagccggctgatgatgcctacggattc

SEQ ID NO: 1780 - DNA, 60 bp, Bacillus sp. SA1-12 scf7180000003373
  misc_feature (1)..(60): LATZ01000021.1/34082-34023 Bacillus sp. SA1-12 scf7180000003373, whole genome shotgun sequence
gttaacataggtgatggagttcacctttaaccgccgttggctaatgactcctgccagtaa

SEQ ID NO: 1781 - DNA, 78 bp, Lachnoclostridium sp. An14
  misc_feature (1)..(78): NFLE01000014.1/2802-2879 Lachnoclostridium sp. An14 An14_contig_14, whole genome shotgun sequence
cacacattcgggaatgaagtgctcccgtaaccgtaattggtaaaaccgcttgagagagctgatgacttctgtgaatac

SEQ ID NO: 1782 - DNA, 77 bp, Lachnospiraceae bacterium 2_1_46FAA
  misc_feature (1)..(77): KE150017.1/129019-128943 Lachnospiraceae bacterium 2_1_46FAA genomic scaffold aclXT-supercont-complete, whole genome shotgun sequence
ggtgatagagggaatgaagttctcccttagttataaaactaaaacctctaatcttagctgatgacttctgcatttag

SEQ ID NO: 1783 - DNA, 62 bp, Sphingobacterium sp. ACCC 05744 h261
  misc_feature (1)..(62): JJMU01000002.1/30791-30852 Sphingobacterium sp. ACCC 05744 h261, whole genome shotgun sequence
tacatctgtggcaatgatatctgcccttaaccgcccaaaaagctgatgatgtctacttaatt

SEQ ID NO: 1784 - DNA, 71 bp, Novosphingobium barchaimii strain NS277
  misc_feature (1)..(71): LDRW01000016.1/291186-291116 Novosphingobium barchaimii strain NS277 contig_16, whole genome shotgun sequence
cgctggcaaggcgatggatttccgccgggcttcggccgaaccgcctccgggctgatgattcctacctgatg

SEQ ID NO: 1785 - DNA, 77 bp, Mesorhizobium loti strain UFLA 01-765
  misc_feature (1)..(77): LPWA01000099.1/48188-48112 Mesorhizobium loti strain UFLA 01-765 contig_20, whole genome shotgun sequence
ccgaaaaatggggatggggttcccccgaaaccgcccacgctcagtacgagtatcgggctgatgactcctgccaggcg

SEQ ID NO: 1786 - DNA, 66 bp, Gluconobacter oxydans 621H plasmid pGOX1
  misc_feature (1)..(66): CP000004.1/152384-152449 Gluconobacter oxydans 621H plasmid pGOX1, complete sequence
tcccgacaaggggatggagctcccccttcaaccgccctcgcaagggctgatggctcctaccgcgac

SEQ ID NO: 1787 - DNA, 70 bp, Acidobacteria bacterium RIFCSPLOWO2_02_FULL_67_21
  misc_feature (1)..(70): MEKU01000048.1/29444-29375 Acidobacteria bacterium RIFCSPLOWO2_02_FULL_67_21 rifcsplowo2_02_scaffold_2758, whole genome shotgun sequence
cgtctcgttggtggtggagtccacctgaaccgccggccccgactggacggccaatgactcctgcggcgat

SEQ ID NO: 1788 - DNA, 76 bp, Jeotgalibaca sp. PTS2502
  misc_feature (1)..(76): CP019433.1/173107-173182 Jeotgalibaca sp. PTS2502, complete genome
aataaaagagggaatgatcgtctcccaaagttgaaataaacttgaaccgcttaaagctgatgacttctacctgttt

SEQ ID NO: 1789 - DNA, 59 bp, Aciduliprofundum boonei T469
  misc_feature (1)..(59): CP001941.1/602419-602477 Aciduliprofundum boonei T469, complete genome
catttataaggtgatggggcccaccaaaccgccgcaaggctgatggctccttttgaaaa

SEQ ID NO: 1790 - DNA, 74 bp, Methylacidiphilum fumariolicum SolV, WGS project CAHT01000000 data
  misc_feature (1)..(74): CAHT01000061.1/22514-22587 Methylacidiphilum fumariolicum SolV, WGS project CAHT01000000 data, contig: 77-2114
caactattgggcgatggggctcgccgtccgttaaccgccactcctttgagaaggctgatagctcctacgattac

SEQ ID NO: 1791 - DNA, 69 bp, Lactobacillus camelliae DSM 22697; identical to SEQ ID NO: 1515
  misc_feature (1)..(69): AYZJ01000062.1/4412-4344 Lactobacillus camelliae DSM 22697 = JCM 13995 strain DSM 22697 NODE_98, whole genome shotgun sequence

SEQ ID NO: 1792 - DNA, 79 bp, Komagataeibacter medellinensis NBRC 3288
  misc_feature (1)..(79): AP012159.1/1360953-1361031 Komagataeibacter medellinensis NBRC 3288 DNA, complete genome
aataaagatggcaatggactctgcctgatttcagccatgaaatcgaaccgcccgccgggctgatgattcctaccccgcc

SEQ ID NO: 1793 - DNA, 80 bp, Komagataeibacter xylinus E25
  misc_feature (1)..(80): CP004360.1/907036-907115 Komagataeibacter xylinus E25 chromosome, complete genome
aagaccgacggcaatggactctgccggaccatgatggtcgaaccgtctcctgcatgggggctgatgattcctacccaacg

SEQ ID NO: 1794 - DNA, 67 bp, Alicyclobacillus sp. USBA-503
  misc_feature (1)..(67): FRAF01000024.1/21577-21643 Alicyclobacillus sp. USBA-503 genome assembly, contig: Ga0105849_124
attgaatccggtgatggagctcaccgtgaactgccggaatgaactggctaatggcccctactgttct

SEQ ID NO: 1795 - DNA, 84 bp, Clostridiales bacterium; identical to SEQ ID NO: 344
  misc_feature (1)..(84): MNRE01000171.1/67202-67285 Clostridiales bacterium 41_21_two_genomes Ley3_66761_scaffold_497, whole genome shotgun sequence

SEQ ID NO: 1796 - DNA, 61 bp, Myroides odoratus DSM 2801
  misc_feature (1)..(61): CM001437.1/1181018-1181078 Myroides odoratus DSM 2801 chromosome, whole genome shotgun sequence
atcataataggcaatgatgtctgcctcgaaccgccttgtagctgatgacgtctagtatact

SEQ ID NO: 1797 - DNA, 80 bp, Treponema caldarium DSM 7334
  misc_feature (1)..(80): CP002868.1/2636695-2636774 Treponema caldarium DSM 7334, complete genome
atttaaagcggtgatggagtccaccttggcaccagcctgaaccgcccgggatatcccctgctgatgactccttccgatac

SEQ ID NO: 1798 - DNA, 62 bp, Burkholderia ginsengiterrae strain DCY85 NODE_5
  misc_feature (1)..(62): LXKA01000349.1/9186-9125 Burkholderia ginsengiterrae strain DCY85 NODE_5, whole genome shotgun sequence
tgttgcgctggagatggcattctcctttaaccgcccttgtggctgatgatgcctgctcgccc

SEQ ID NO: 1799 - DNA, 61 bp, Lactobacillus amylolyticus DSM 11664
  misc_feature (1)..(61): ADNY01000026.1/2434-2494 Lactobacillus amylolyticus DSM 11664 contig00030, whole genome shotgun sequence
aatcaaataggcgatgacgttcgccattaactgagtaaaatctgatgacgtctactacctc

SEQ ID NO: 1800 - DNA, 76 bp, Facklamia ignava CCUG 37419
  misc_feature (1)..(76): JH932301.1/637310-637385 Facklamia ignava CCUG 37419 genomic scaffold supercont1.2, whole genome shotgun sequence
ttgaagataggaaatgaggttcttccttagccgtatggcttaaactgctttgaatgctgatgacttctacctgttc

SEQ ID NO: 1801 - DNA, 62 bp, Alicyclobacillus acidoterrestris ATCC 49025
  misc_feature (1)..(62): AURB01000141.1/44632-44571 Alicyclobacillus acidoterrestris ATCC 49025 contig_39, whole genome shotgun sequence
aattgcatcggtgatggagctcaccaacatcacccgaaagggttaatggctcctgcgaaggt

SEQ ID NO: 1802 - DNA, 83 bp, Arthrobacter sp. AK-YN10
  misc_feature (1)..(83): AVPD02000038.1/14384-14302 Arthrobacter sp. AK-YN10 contig038, whole genome shotgun sequence
tgttgtaatggtgatggatcccaccggggccgattgattggctggcctggaccgccgacgtggctgatggttcctgctccgac

SEQ ID NO: 1803 - DNA, 61 bp, Caldanaerobius fijiensis DSM 17918
  misc_feature (1)..(61): FQVH01000001.1/130089-130029 Caldanaerobius fijiensis DSM 17918 genome assembly, contig: EJ21DRAFT_scaffold00001.1
aaattaataggtgatgggactcaccattatgtgccttaaggctgatggttcctactaagtt

SEQ ID NO: 1804 - DNA, 73 bp, Mycobacterium abscessus strain PAP053; identical to SEQ ID NO: 1088
  misc_feature (1)..(73): CSXB01000013.1/23266-23194 Mycobacterium abscessus strain PAP053 genome assembly, contig: ERS075544SCcontig000013

SEQ ID NO: 1805 - DNA, 63 bp, Methyloligella halotolerans strain VKM B-2706
  misc_feature (1)..(63): MASI01000011.1/38499-38437 Methyloligella halotolerans strain VKM B-2706 A7A08_contig000011, whole genome shotgun sequence
accaatgaaggggatggggttccccgacaaccgtccatgaggactgatgactcctgtttgcta

SEQ ID NO: 1806 - DNA, 77 bp, Dehalogenimonas alkenigignens strain IP3-3
  misc_feature (1)..(77): KQ758903.1/235653-235729 Dehalogenimonas alkenigignens strain IP3-3 genomic scaffold scaffold00001, whole genome shotgun sequence
tcgtaaagcggcgatgaagctcgccaaggaattttcacctgaaccgcttgcttaaggctgatagcttctaccggtat

SEQ ID NO: 1807 - DNA, 64 bp, Streptomyces sp. Tu 6176
  misc_feature (1)..(64): KK106994.1/337598-337535 Streptomyces sp. Tu 6176 genomic scaffold scaffold00007, whole genome shotgun sequence
cgtcgccatggcgatggggctcgccacaaccgcaggacctcctgctgatggcctctaccggtaa

SEQ ID NO: 1808 - DNA, 65 bp, Sporomusa malonica strain DSM 5090
  misc_feature (1)..(65): FWXI01000013.1/81729-81793 Sporomusa malonica strain DSM 5090 genome assembly, contig: Ga0070592_113
gatgtttggggcgatggagttcgccattaaatccgtaaacaggcggtgatgactcctaccaggta

SEQ ID NO: 1809 - DNA, 63 bp, Deltaproteobacteria bacterium
  misc_feature (1)..(63): MNFK01000012.1/837-775 Deltaproteobacteria bacterium 13_1_40CM_4_54_4 13_1_40cm_4_scaffold_19741, whole genome shotgun sequence
attgcctgcggagatggcgttctccattaactgcccgccagggctgatgacgcctacttcaat

SEQ ID NO: 1810 - DNA, 70 bp, Betaproteobacteria bacterium
  misc_feature (1)..(70): MERG01000081.1/42967-43036 Betaproteobacteria bacterium RIFCSPLOWO2_12_FULL_62_13 rifcsplowo2_12_scaffold_1558, whole genome shotgun sequence
gctcggtagggagatggcattcctcccggaataagaaccgcctgaaatggctgatgatgcctactgtgtc

SEQ ID NO: 1811 - DNA, 62 bp, Mycobacterium xenopi 3993
  misc_feature (1)..(62): JAOC01000010.1/319581-319520 Mycobacterium xenopi 3993 GMX3993.contig.9, whole genome shotgun sequence
tcgcggacaggcgatgaggctcgccttgaactgccacaacggctaatggcttctacccgtga

SEQ ID NO: 1812 - DNA, 69 bp, Burkholderia sp. TJI49
  misc_feature (1)..(69): AEXE01000085.1/6764-6696 Burkholderia sp. TJI49 contig072.1, whole genome shotgun sequence
tgctccgaaggagatggcattcctcccaccaaaccgccgcgcaagtcggctaatgatgcctacgtgatc

SEQ ID NO: 1813 - DNA, 73 bp, Archaeon Odin LCB_4
  misc_feature (1)..(73): MDVT01000007.1/146532-146604 Archaeon Odin LCB_4 OdinLCB4_contig000007, whole genome shotgun sequence
ataaacgtcagcgatggagtccgctgtgggtgtaagcctaaaccgcttttaagctgatgactcctatcttttt

SEQ ID NO: 1814 - DNA, 89 bp, Rhodococcus sp. EPR-157
  misc_feature (1)..(89): LVCV01000312.1/20328-20240 Rhodococcus sp. EPR-157 Scaffold28_4, whole genome shotgun sequence
attgcggctggcgatggatctccgcctagatcgcccgtcaagggttgtctgaaccgccccagcccggggctgatggctcctttccctga

SEQ ID NO: 1815 - DNA, 69 bp, Peptoniphilus coxii strain DNF00729
  misc_feature (1)..(69): KQ960178.1/16010-16078 Peptoniphilus coxii strain DNF00729 genomic scaffold Scaffold207, whole genome shotgun sequence
aagaaaatagggaatgaagttctcccttgggcaacctaaaccgcaacagctgatgacttctacgatttt

SEQ ID NO: 1816 - DNA, 64 bp, Acidiferrobacter thiooxydans strain ZJ
  misc_feature (1)..(64): MDCF01000112.1/526-463 Acidiferrobacter thiooxydans strain ZJ Contig_2, whole genome shotgun sequence
acgagaacaggagatggcattcctcctcataaccgccctaccggctgatgatgcctacatagtc

SEQ ID NO: 1817 - DNA, 64 bp, Streptomyces griseofuscus strain NG1-7
  misc_feature (1)..(64): MTKC01000003.1/5837480-5837417 Streptomyces griseofuscus strain NG1-7 NG1-17_1_1, whole genome shotgun sequence
tatggagagggcgatgaggctcgcccttgaccgcacatcctgtgctgatggcctctacctctcc

SEQ ID NO: 1818 - DNA, 69 bp, Burkholderia gladioli BSR3
  misc_feature (1)..(69): CP002600.1/2792828-2792760 Burkholderia gladioli BSR3 chromosome 2, complete sequence
gtgcttgccggagatggcattcctccgtacacaaccgccggtcagccggctgatgatgcctacgcatcc

SEQ ID NO: 1819 - DNA, 72 bp, Negativicoccus succinicivorans DORA_17_25 Q612_NSC00279V
  misc_feature (1)..(72): AZMC01000279.1/8695-8624 Negativicoccus succinicivorans DORA_17_25 Q612_NSC00279, whole genome shotgun sequence
tgtatgaaagggaatgaagttctcccttgggtaacctaaaccgtttattaagctgatgacttctacaattac

SEQ ID NO: 1820 - DNA, 62 bp, Burkholderia sp. TJI49
  misc_feature (1)..(62): AEXE01000084.1/14637-14698 Burkholderia sp. TJI49 contig072, whole genome shotgun sequence
ttccagcgaggagatggcattctccgttgaaccgcctcacggctgatgatgcctacgaaccc

SEQ ID NO: 1821 - DNA, 71 bp, Thermodesulfovibrio sp.
  misc_feature (1)..(71): MIDI01000122.1/18129-18059 Thermodesulfovibrio sp. RBG_19FT_COMBO_42_12 rbg_19ft_combo_scaffold_289, whole genome shotgun sequence
cttaatatgagcgatggggttcgctgttaaccgtccttgattgtttaaggaatgataacccctactgaacc

SEQ ID NO: 1822 - DNA, 62 bp, Deltaproteobacteria bacterium RBG_13_51_10
  misc_feature (1)..(62): MGQE01000007.1/10900-10839 Deltaproteobacteria bacterium RBG_13_51_10 RBG_13_scaffold_11549_curated, whole genome shotgun sequence
attatctccggcgatggagtccgccagaaccgcctttccaggctgatgactcctgccaaggt

SEQ ID NO: 1823 - DNA, 60 bp, Sporanaerobacter sp. PP17-6a isolate PP176A
  misc_feature (1)..(60): FMIF01000028.1/62135-62076 Sporanaerobacter sp. PP17-6a isolate PP176A genome assembly, contig: PP17-6a_contig28
taaaattcaggtgatggagttcacctttaaatgctttttgctaatgactcctccttaata

SEQ ID NO: 1824 - DNA, 62 bp, Methylosinus sp. R-45379
  misc_feature (1)..(62): LUUM01000113.1/172427-172488 Methylosinus sp. R-45379 contig_20, whole genome shotgun sequence
gtgcggccgggggatggggtcccccttcaaccgccgcaaaggctgatgactcctgctgatgt

SEQ ID NO: 1825 - DNA, 64 bp, Methanobacterium sp. AL-21
  misc_feature (1)..(64): CP002551.1/1432273-1432210 Methanobacterium sp. AL-21, complete genome
atatggaatggtgatggggttcacctttaaccgcttattttaagctgatgactcctgcacaata

SEQ ID NO: 1826 - DNA, 73 bp, Mycobacterium tusciae strain DSM 44153
  misc_feature (1)..(73): MVIM01000009.1/203384-203456 Mycobacterium tusciae strain DSM 44153 NODE_9_length_212353_cov_68.0015, whole genome shotgun sequence
cttcgaagtggtgatggatctcgcccgagctcgtcgctcgaaccgccaattggctgatagttcctgccgtcat

SEQ ID NO: 1827 - DNA, 67 bp, Desulfacinum hydrothermale DSM 13146
  misc_feature (1)..(67): FWXF01000003.1/222602-222668 Desulfacinum hydrothermale DSM 13146 genome assembly, contig: EJ40DRAFT_scaffold00003.3
aaaacgaaaggcaatgaagtctgcctgaaacgccctcacgttctgggatgatgacttctactcacgc

SEQ ID NO: 1828 - DNA, 65 bp, Frateuria aurantia DSM 6220
  misc_feature (1)..(65): CP003350.1/2397153-2397217 Frateuria aurantia DSM 6220, complete genome
ttttcgatgggagatggcatgcctcctgtcccaaccgccgcaaggctgatgatgcctacgccacc

SEQ ID NO: 1829 - DNA, 63 bp, Pelotomaculum thermopropionicum SI DNA
  misc_feature (1)..(63): AP009389.1/615295-615357 Pelotomaculum thermopropionicum SI DNA, complete genome
atattttctggcgatggggctcgccttaattttgctgaaaaagctgatagctcctacccgtaa

SEQ ID NO: 1830 - DNA, 61 bp, Mycobacterium sherrisii strain BC1_M4
  misc_feature (1)..(61): MIHC01000025.1/15457-15517 Mycobacterium sherrisii strain BC1_M4 PROKKA_contig000025, whole genome shotgun sequence
tcgctgacaggtgatgaggctcaccttcaaccgccatacggctaatggcttctacccactg

SEQ ID NO: 1831 - DNA, 65 bp, Deinococcus geothermalis DSM 11300 plasmid pDGEO01
  misc_feature (1)..(65): CP000358.2/504027-504091 Deinococcus geothermalis DSM 11300 plasmid pDGEO01, complete sequence
agcaacacaggcgatggcatgcgccttgaaccgccccgcgtccggctgattatgcctaccttccc

SEQ ID NO: 1832 - DNA, 99 bp, Nocardia nova SH22a
  misc_feature (1)..(99): CP006850.1/5443985-5443887 Nocardia nova SH22a, complete genome
gaagatgtaggcgatggagctcgcctcaaccgcgccagccgaggtcctgtgacgatgcgggcctttacagcggttcgcgctgatagctcctaccgatcc

SEQ ID NO: 1833 - DNA, 68 bp, Chryseobacterium gambrini strain DSM 18014
  misc_feature (1)..(68): FTOV01000006.1/110401-110334 Chryseobacterium gambrini strain DSM 18014 genome assembly, contig: Ga0111674_106
agtacaaaaggaaatggtgttcttccttacccaaccgcttttcaaaagctgatgacgcctgattaaaa

SEQ ID NO: 1834 - DNA, 68 bp, Bacteroidetes bacterium 43-93
  misc_feature (1)..(68): MKUO01000007.1/339798-339731 Bacteroidetes bacterium 43-93 SCNpilot_expt_1000_bf_scaffold_15, whole genome shotgun sequence
tacgcaaaaggaaatggtgtcttcctgtaataaaccgctttaaagaagctgatggcgcctgcagaccg

SEQ ID NO: 1835 - DNA, 96 bp, [Oscillatoria] sp. PCC 6506, WGS project CACA01000000 data
  misc_feature (1)..(96): CACA01000037.1/3863-3958 [Oscillatoria] sp. PCC 6506, WGS project CACA01000000 data, contig: Contig41
aatcccaacggcaatggagctcgccaaaaccgcctgctagtgattctttcctaacgttaactaaaacactaaaaggctgatggctcctacttttct

SEQ ID NO: 1836 - DNA, 75 bp, Photobacterium iliopiscarium strain ATCC 51761
  misc_feature (1)..(75): JZSR01000015.1/16083-16157 Photobacterium iliopiscarium strain ATCC 51761 CFSAN029430_contig0014, whole genome shotgun sequence
tttatagcgggagatgatgttcctcctttaaccgccttaatgactttctttaaggataatgacgtctgacaacat

SEQ ID NO: 1837 - DNA, 61 bp, Caldanaerobius fijiensis DSM 17918
  misc_feature (1)..(61): FQVH01000013.1/28639-28579 Caldanaerobius fijiensis DSM 17918 genome assembly, contig: EJ21DRAFT_scaffold00013.13
ctttaataaggcgatggagctcgccttaaatgcctgagatgctgatggctcctgcttttaa

SEQ ID NO: 1838 - DNA, 67 bp, Aminobacterium colombiense DSM 12261
  misc_feature (1)..(67): CP001997.1/35922-35856 Aminobacterium colombiense DSM 12261, complete genome
taaatagcgggtgatggggttcaccataaatactataaatgcgaaagctgatgactcctacaagtat

SEQ ID NO: 1839 - DNA, 87 bp, Humibacillus sp. DSM 29435
  misc_feature (1)..(87): MAST01000004.1/35803-35889 Humibacillus sp. DSM 29435 contig12, whole genome shotgun sequence
tggtatacgggtgatggagcttgcccgagaagccaggtgaccctggcttttcaaaccgccaagatggctgatagcccctgagatctt

SEQ ID NO: 1840 - DNA, 73 bp, Flavonifractor plautii ATCC 29863
  misc_feature (1)..(73): JH417664.1/1346-1274 Flavonifractor plautii ATCC 29863 genomic scaffold Scfld64, whole genome shotgun sequence
ccggaacacgggaatgaggttctcccggggcgctggcccgaaccgccgcttggctgatgacttctgcaagaga

SEQ ID NO: 1841 - DNA, 79 bp, Gluconobacter oxydans 621H
  misc_feature (1)..(79): CP000009.1/2355903-2355981 Gluconobacter oxydans 621H, complete genome
gaggcagaaggcaatggattctgcctgaccgttcccggtcgaaccgcttcatccggaagctgatgattcctgtccctcg

SEQ ID NO: 1842 - DNA, 61 bp, Nitrobacter sp. 62-23
  misc_feature (1)..(61): MKSM01000129.1/35964-36024 Nitrobacter sp. 62-23 SCNpilot_cont_300_bf_scaffold_793, whole genome shotgun sequence
gaaatcgatggggatggggtcccccgacaaccgccgcgaggctaatgactcctaccgggcg

SEQ ID NO: 1843 - DNA, 64 bp, Geosporobacter subterraneus DSM 17957
  misc_feature (1)..(64): FQZV01000012.1/15866-15803 Geosporobacter subterraneus DSM 17957 genome assembly, contig: EJ58DRAFT_scaffold00010.10
aaccattaaggtgatggagctcaccgtaaacattgctgcagcaattaatggctcctactaagga

SEQ ID NO: 1844 - DNA, 73 bp, Luteimonas sp. FCS-9 scf7180000000232
  misc_feature (1)..(73): LASZ01000009.1/144060-143988 Luteimonas sp. FCS-9 scf7180000000232, whole genome shotgun sequence
gccgccgacgggaatggggcttcccgataaccgccggccggtgcacggtccggctgatggcgcctgctgccaa

SEQ ID NO: 1845 - DNA, 74 bp, Gluconobacter oxydans H24
  misc_feature (1)..(74): CP003926.1/1812802-1812729 Gluconobacter oxydans H24, complete genome
ataaacgaaggcaatggactctgcctggccatcgtggccgaaccgcccccagggctgatgactcctacctcgcc

SEQ ID NO: 1846 - DNA, 60 bp, Caldalkalibacillus thermarum TA2.A1 ctg149; identical to SEQ ID NO: 437
  misc_feature (1)..(60): AFCE01000056.1/840-781 Caldalkalibacillus thermarum TA2.A1 ctg149, whole genome shotgun sequence

SEQ ID NO: 1847 - DNA, 78 bp, Novosphingobium sp. Fuku2-ISO-50 PRJNA299316_s005
  misc_feature (1)..(78): KQ954289.1/11573-11496 Novosphingobium sp. Fuku2-ISO-50 genomic scaffold PRJNA299316_s005, whole genome shotgun sequence
ctgtcatacggcgatggatttccgccgggttttcgggccgaaccgcctttaccaaaggctgatgattcctacctgacg

SEQ ID NO: 1848 - DNA, 61 bp, Paenibacillus sp. D9
  misc_feature (1)..(61): JZEJ01000001.1/4961423-4961483 Paenibacillus sp. D9 Scaffold1, whole genome shotgun sequence
aaccgcataggcgatggagttcgcctttaaacgcccaagggctgatgactcctaccagcgc

SEQ ID NO: 1849 - DNA, 61 bp, Betaproteobacteria bacterium RIFCSPLOWO2_12_FULL_62_13b; identical to SEQ ID NO: 399
  misc_feature (1)..(61): MERH01000157.1/5469-5529 Betaproteobacteria bacterium RIFCSPLOWO2_12_FULL_62_13b rifcsplowo2_12_scaffold_3504, whole genome shotgun sequence

SEQ ID NO: 1850 - DNA, 66 bp, Clostridium ventriculi strain 2789STDY5834858
  misc_feature (1)..(66): CYZR01000001.1/463859-463924 Clostridium ventriculi strain 2789STDY5834858 genome assembly, contig: SCcontig000001
aatttaatgggttatggagttaaccctaaaccgctttattttaaagctaatgactcctacacaaaa

SEQ ID NO: 1851 - DNA, 76 bp, Candidatus Methanoperedens nitroreducens strain ANME-2d
  misc_feature (1)..(76): JMIY01000007.1/446381-446306 Candidatus Methanoperedens nitroreducens strain ANME-2d ANME2D_Contig_7.7, whole genome shotgun sequence
ttatatgtgggcgatgaggttcgccttggtattagcctaaattgtctcgatcgagactgataacttctattttcaa

SEQ ID NO: 1852 - DNA, 85 bp, Sulfolobus solfataricus P2
  misc_feature (1)..(85): AE006641.1/885812-885728 Sulfolobus solfataricus P2, complete genome
aatgaagtaggggatggcgtccccctggggataaccccgaaccgcctcttgattaatgataggggctgatgacgcctacttcacc

SEQ ID NO: 1853 - DNA, 62 bp, Hyphomicrobium denitrificans ATCC 51888
  misc_feature (1)..(62): CP002083.1/228539-228600 Hyphomicrobium denitrificans ATCC 51888, complete genome
gccgtcgatggggatggggttccccgataaccgccgctatggctgatgactcctggcgaggc

SEQ ID NO: 1854 - DNA, 64 bp, Thermanaerothrix daxensis strain GNS-1
  misc_feature (1)..(64): LGKO01000006.1/133282-133345 Thermanaerothrix daxensis strain GNS-1 contig_4, whole genome shotgun sequence
gatctcgctggcgatgaggctcgcctgaaaccgtcggttcacgactgatagcctctgcccctga

SEQ ID NO: 1855 - DNA, 62 bp, Clostridium sp. W14A NODE_4
  misc_feature (1)..(62): MBSV01000072.1/130026-130087 Clostridium sp. W14A NODE_4, whole genome shotgun sequence
gtaaataccggtgatgaggctcaccgtaatcgcatcttaatgctgacggcttctgctttaag

SEQ ID NO: 1856 - DNA, 61 bp, Hyphomicrobium denitrificans 1NES1
  misc_feature (1)..(61): CP005587.1/724703-724643 Hyphomicrobium denitrificans 1NES1, complete genome
tcgcgcgatggggatggagtcccccgataaccgccataaggctgatggctcctaccgagcg

SEQ ID NO: 1857 - DNA, 74 bp, Ruminococcus albus 8
  misc_feature (1)..(74): ADKM02000108.1/1643-1570 Ruminococcus albus 8 contig00006, whole genome shotgun sequence
atttcatacgggaatgatgttctcccacgggaaaccgaaaccgcttatcataagctgatgacttctgcgtttta

SEQ ID NO: 1858 - DNA, 71 bp, Deltaproteobacteria bacterium CSP1-8 XU12_C0001
  misc_feature (1)..(71): LDXO01000001.1/181398-181468 Deltaproteobacteria bacterium CSP1-8 XU12_C0001, whole genome shotgun sequence
aggaaaataggcgatggagttcgccgaaaaaaccgcctgtccttccgacggctgatgactcctgcgacgga

SEQ ID NO: 1859 - DNA, 63 bp, Acetonema longum DSM 6540
  misc_feature (1)..(63): AFGF01000078.1/30229-30167 Acetonema longum DSM 6540 Contig00078, whole genome shotgun sequence
tacaatatcggcgatggagttcgccttaaaccccgtgcaaacggtaatgactcctaccactga

SEQ ID NO: 1860 - DNA, 69 bp, Photobacterium aphoticum strain DSM 25995
  misc_feature (1)..(69): LDOV01000006.1/43313-43245 Photobacterium aphoticum strain DSM 25995 contig0006, whole genome shotgun sequence
gcccgtgcgggagatgatgttcctcctttaaccgcccgtttcattagggatgatgacgtctaacaacaa

SEQ ID NO: 1861 - DNA, 63 bp, Thermus scotoductus SA-01
  misc_feature (1)..(63): CP001962.1/1044224-1044286 Thermus scotoductus SA-01, complete genome
tgtcctcgaggcgatggggcccgcctgaaaccgcccagccgggctgatggctcctacccagaa

SEQ ID NO: 1862 - DNA, 78 bp, Bradyrhizobium japonicum USDA 110
  misc_feature (1)..(78): BA000040.2/2887392-2887315 Bradyrhizobium japonicum USDA 110 DNA, complete genome
cgcacagatggggatggagtcccccgacaaccgcccggcggtaggtgaccgtgatgggctgatgactcctgcttgagg

SEQ ID NO: 1863 - DNA, 63 bp, Lasius niger Lnig_2.1_8699; identical to SEQ ID NO: 1484
  misc_feature (1)..(63): LBMM01008604.1/1742-1680 Lasius niger Lnig_2.1_8699, whole genome shotgun sequence

SEQ ID NO: 1864 - DNA, 72 bp, Bacteria symbiont BFo2 of Frankliniella occidentalis strain BFo2; identical to SEQ ID NO: 1705
  misc_feature (1)..(72): JMSP01000269.1/1616-1545 Bacteria symbiont BFo2 of Frankliniella occidentalis strain BFo2 contig416, whole genome shotgun sequence

SEQ ID NO: 1865 - DNA, 72 bp, Acidipropionibacterium acidipropionici ATCC 4875
  misc_feature (1)..(72): CP003493.1/112663-112734 Acidipropionibacterium acidipropionici ATCC 4875 chromosome, complete genome
tgtgggcagggcgatggaacccgcccggggattctcccgaaccgccactcggctgatggtccctgcacgtcg

SEQ ID NO: 1866 - DNA, 71 bp, Frateuria sp. Soil773
  misc_feature (1)..(71): LMSL01000040.1/127758-127688 Frateuria sp. Soil773 contig_8, whole genome shotgun sequence
caaaccaagggagatggcattcctcccgggccgtgcccaatcgccgcaaggctgatgatgcctatcgaacg

SEQ ID NO: 1867 - DNA, 73 bp, Clostridium sp. ATCC 29733
  misc_feature (1)..(73): KE993512.1/158596-158668 Clostridium sp. ATCC 29733 genomic scaffold Scaffold1, whole genome shotgun sequence
agaagattggggaatgaagtgctcccccgggcaaccgaaaccgcttttgtaagctgatgacttctgtgatttt

SEQ ID NO: 1868 - DNA, 77 bp, Rhodococcus triatomae strain DSM 44892
  misc_feature (1)..(77): FNDN01000013.1/66675-66751 Rhodococcus triatomae strain DSM 44892 genome assembly, contig: Ga0116918_113
aatcgtgacggcgatggatctccgccggggcacctgcccgaaccgcctcacccgaggctgatggctcctttcccacc

SEQ ID NO: 1869 - DNA, 61 bp, Brenneria goodwinii strain OBR1
  misc_feature (1)..(61): CGIG01000001.1/172208-172268 Brenneria goodwinii strain OBR1 genome assembly, contig: Contig
gtgcaaaacggagatgacattcctccataaccgccattcggctgatgatgtctatgcactt

SEQ ID NO: 1870 - DNA, 97 bp, Aerococcus viridans ATCC 11563 = CCUG 4311 strain ATCC 11563
  misc_feature (1)..(97): ADNT01000040.1/13066-12970 Aerococcus viridans ATCC 11563 = CCUG 4311 strain ATCC 11563 contig00050, whole genome shotgun sequence
ataaaaagagggaatgaggttctccctggtcaagtagatggtgattttaggccatcccataccgaaccgctgaaaagctgatgacttctgcaagtaa

SEQ ID NO: 1871 - DNA, 69 bp, Thermodesulfovibrio sp. N1
  misc_feature (1)..(69): MAVV01000020.1/15342-15274 Thermodesulfovibrio sp. N1 contig00020, whole genome shotgun sequence
attaaaaaaggcgatggagttcgcctttaagtgcctctgattttcagggctgataactcctacttgaaa

SEQ ID NO: 1872 - DNA, 74 bp, Enterococcus sp. RIT-PI-f
  misc_feature (1)..(74): LHOX01000015.1/364503-364576 Enterococcus sp. RIT-PI-f contig_2, whole genome shotgun sequence
cgtaaataagggaatgaatgtctccctcagtgatgctggaaccgcaaatgattgctaatgacttctacaggctt

SEQ ID NO: 1873 - DNA, 93 bp, Bifidobacterium psychraerophilum strain LMG 21775
  misc_feature (1)..(93): JGZI01000010.1/76150-76242 Bifidobacterium psychraerophilum strain LMG 21775 Contig10, whole genome shotgun sequence
ggcgtggttgggtatgaagttaccctaggcaccaaaatgaaacacagtacatacgcctgaaccgctcaacgagctgatgacttctgcagagat

SEQ ID NO: 1874 - DNA, 69 bp, Dysgonomonas mossii DSM 22836
  misc_feature (1)..(69): GL892006.1/282867-282935 Dysgonomonas mossii DSM 22836 genomic scaffold supercont1.3, whole genome shotgun sequence
cgaaattaagggaatgggacttccctgttataaaccgctaataaagtagctgatagttcctgcttaact

SEQ ID NO: 1875 - DNA, 62 bp, Altererythrobacter sp. 66-12
  misc_feature (1)..(62): MKSE01000017.1/211467-211528 Altererythrobacter sp. 66-12 SCNpilot_expt_1000_bf_scaffold_653, whole genome shotgun sequence
gcccccgcagggaatggggtctcccttgtaaccgcgatcgtgctgatgactcctgctttatc

SEQ ID NO: 1876 - DNA, 75 bp, Fischerella sp. JSC-11
  misc_feature (1)..(75): AGIZ01000001.1/283970-283896 Fischerella sp. JSC-11 ctg118, whole genome shotgun sequence
aagagtatcggtgatgaaactcaccatttggtttttccagagaaccacctccgggctgatagtttctagctctca

SEQ ID NO: 1877 - DNA, 72 bp, Clostridium hathewayi WAL-18680
  misc_feature (1)..(72): JH379030.1/280351-280280 Clostridium hathewayi WAL-18680 genomic scaffold supercont1.4, whole genome shotgun sequence
tgggcgggagggaatgaagttctcccgggggaaacctgaaccgctttttgagctgatgacttctgtgatatg

SEQ ID NO: 1878 - DNA, 75 bp, Hymenobacter gelipurpurascens strain DSM 11116
  misc_feature (1)..(75): FYEW01000001.1/407799-407873 Hymenobacter gelipurpurascens strain DSM 11116 genome assembly, contig: Ga0170436_11
ccataacccggtgatggggtaccaccataaaccgccgaagctccagggctttgcgctgatgactcctgcgttgcc

SEQ ID NO: 1879 - DNA, 77 bp, Candidatus Burkholderia calva strain UZHbot6 BUMB
  misc_feature (1)..(77): LFLF01000036.1/26287-26363 Candidatus Burkholderia calva strain UZHbot6 BUMBctg_36, whole genome shotgun sequence
tgtaacataggagatggcattttcctgtggttctcccgctaatcgctcctcgatgagccgatgatacctacccacac

SEQ ID NO: 1880 - DNA, 81 bp, Streptomyces sp. Tu 6176
  misc_feature (1)..(81): KK106988.1/2431313-2431233 Streptomyces sp. Tu 6176 genomic scaffold scaffold00001, whole genome shotgun sequence
ctcggactcggcgatggatcccgcctgggccgttctccggcccgaaccgccctcctccgggctgatggttcctgaccgacg

SEQ ID NO: 1881 - DNA, 65 bp, Mucilaginibacter paludis DSM 18603
  misc_feature (1)..(65): CM001403.1/3147625-3147561 Mucilaginibacter paludis DSM 18603 chromosome, whole genome shotgun sequence
ttaaacaaaggtgatggtgttccacctaattgaaccgctgcaaagctgatgacgcctgccaaata

SEQ ID NO: 1882 - DNA, 68 bp, Lentisphaerae bacterium GWF2_49_21
  misc_feature (1)..(68): MHBH01000023.1/31060-31127 Lentisphaerae bacterium GWF2_49_21 gwf2_scaffold_1613, whole genome shotgun sequence
gatgatctaggcgatgaggttcgccttataaccgtggctcgaatgcctctgatgacctctacctttgc

SEQ ID NO: 1883 - DNA, 75 bp, Scytonema millei VB511283
  misc_feature (1)..(75): JTJC02000078.1/5340-5266 Scytonema millei VB511283 scaffold_192, whole genome shotgun sequence
tgaaacataggtgatgagactcaccttctggaatctccagagaaccgcctcctggctgatagtctctacctcaat

SEQ ID NO: 1884 - DNA, 64 bp, Acidomonas methanolica NBRC 104435
  misc_feature (1)..(64): BAND01000009.1/6158-6221 Acidomonas methanolica NBRC 104435 DNA, contig: Amme_009
attcggataggagatggggttcctccttttaaccgccgcatcggctgatgactcctggcatgac

SEQ ID NO: 1885 - DNA, 65 bp, Mucilaginibacter sp. PAMC 26640
  misc_feature (1)..(65): CP014773.1/1898664-1898728 Mucilaginibacter sp. PAMC 26640, complete genome
taaaaacaaggcaatggtgttctgcctatttgaaccgctgcaaagctgatgacgcctacccaaat

SEQ ID NO: 1886 - DNA, 73 bp, Lactococcus lactis subsp. lactis Il1403
  misc_feature (1)..(73): AE005176.1/274025-274097 Lactococcus lactis subsp. lactis Il1403, complete genome
atagtagatgggtatggtgcacacccgaaaccgtttcaagaaatagcttgaatctaatggcgcctacaaagca

SEQ ID NO: 1887 - DNA, 87 bp, Rhizobiales bacterium 64-17
  misc_feature (1)..(87): MKWA01000009.1/237030-237116 Rhizobiales bacterium 64-17 SCNpilot_cont_500_bf_scaffold_256, whole genome shotgun sequence
cgccgcgatggggatggggttcccccgaaaccgcccaacgccgcgtccagaacgattggcgtaagggctgatgactcctgccgaaca

SEQ ID NO: 1888 - DNA, 61 bp, Clostridium pasteurianum BC1
  misc_feature (1)..(61): CP003261.1/2076238-2076298 Clostridium pasteurianum BC1, complete genome
taagtcataggtgatggagttcgcctttaaatgcttgaatgctgatgactcctacaggtct

SEQ ID NO: 1889 - DNA, 76 bp, Sphingomonas sp. 67-41
  misc_feature (1)..(76): MKWJ01000020.1/50891-50816 Sphingomonas sp. 67-41 SCNpilot_cont_300_bf_scaffold_301, whole genome shotgun sequence
gccgatcacggcaatggattcctgccgggctcgtccgagccgaaccgcccgcaaggctgatgattcctacctgtcg

SEQ ID NO: 1890 - DNA, 63 bp, Rhizobiales bacterium 65-79
  misc_feature (1)..(63): MKRJ01000017.1/40177-40115 Rhizobiales bacterium 65-79 SCNpilot_cont_1000_bf_scaffold_222, whole genome shotgun sequence
aggacaacaggggatggagtccccctctgaactgccgaagaggctgatgactcctgccgcgac

SEQ ID NO: 1891 - DNA, 71 bp, Burkholderia sp. TJI49
  misc_feature (1)..(71): AEXE01000084.1/23803-23733 Burkholderia sp. TJI49 contig072, whole genome shotgun sequence
tgaacaagcggagatggcattctccctgaaccgccgtgccttcaggcgcggctgatgatgcctaccagtcc

SEQ ID NO: 1892 - DNA, 61 bp, Desulfosporosinus sp. OL
  misc_feature (1)..(61): MLBF01000005.1/61041-61101 Desulfosporosinus sp. OL contig00005, whole genome shotgun sequence
gttatttcaggtgatggggctcaccttataaatgccaacagctaatggctcctactttcaa

SEQ ID NO: 1893 - DNA, 63 bp, Oryza sativa Indica Group scaffold001625; identical to SEQ ID NO: 1484
  misc_feature (1)..(63): CH399130.1/3910-3972 Oryza sativa Indica Group scaffold001625 genomic scaffold, whole genome shotgun sequence

SEQ ID NO: 1894 - DNA, 63 bp, Mucilaginibacter sp. OK098
  misc_feature (1)..(63): FRCM01000010.1/62473-62411 Mucilaginibacter sp. OK098 genome assembly, contig: Ga0066759_110
cttgcatcaggaaatggtgtcttccttttaaaaaccgcattcgctgatgacgcctgcaacatc

SEQ ID NO: 1895 - DNA, 64 bp, Bradyrhizobium elkanii strain UASWS1015
  misc_feature (1)..(64): JXOF01000156.1/24392-24329 Bradyrhizobium elkanii strain UASWS1015 Contig156, whole genome shotgun sequence
aatatagatggggatggagtcccccgatacccgcccgtcgtgggctgatgactcctgctgggat

SEQ ID NO: 1896 - DNA, 74 bp, Hymenobacter daecheongensis DSM 21074
  misc_feature (1)..(74): FQYN01000002.1/205852-205779 Hymenobacter daecheongensis DSM 21074 genome assembly, contig: EJ57DRAFT_scaffold00002.2
cctgcttacggtgatggatttccaccgcgaaccgccggtgccccgcgccccgcgctgatgattcctacgcaacg

SEQ ID NO: 1897 - DNA, 72 bp, Streptomyces griseofuscus strain NG1-7
  misc_feature (1)..(72): MTKC01000003.1/5840543-5840614 Streptomyces griseofuscus strain NG1-7 NG1-17_1_1, whole genome shotgun sequence
ctcgacctcggcgatggatcccgcctggacctcggtccgaaccgcccccgggctgatggttcctgaccgacg

SEQ ID NO: 1898 - DNA, 76 bp, Ensifer sp. LCM 4579
  misc_feature (1)..(76): MDDV01000059.1/288092-288017 Ensifer sp. LCM 4579 contig_7, whole genome shotgun sequence
tggcacgtcggcaatggattctgccaggcatcaagccgaaccgcttccccacgaagctgatgactcctgctcatga

SEQ ID NO: 1899 - DNA, 88 bp, Rhizobium freirei PRF 81
  misc_feature (1)..(88): AQHN01000001.1/36899-36812 Rhizobium freirei PRF 81 Cont658, whole genome shotgun sequence
aaattcaacggtaatggatttctgccgggccatggtggccgaaccgctgctctgattttccagggaagctgatgactcctactcaaaa

SEQ ID NO: 1900 - DNA, 68 bp, Bacteroidetes bacterium 47-18
  misc_feature (1)..(68): MKSF01000006.1/50415-50348 Bacteroidetes bacterium 47-18 scnpilot_p_inoc_scaffold_176, whole genome shotgun sequence
gataaaaaaggaaatggtgtgcttccttacccaaccgctttccacaagctgatgacgcctgatcatta

SEQ ID NO: 1901 - DNA, 78 bp, Roseburia sp. CAG:18
  misc_feature (1)..(78): HF997767.1/2167-2244 Roseburia sp. CAG:18 genomic scaffold, scf259
tctgtcaatgggaatgaagttctcccaagggaatttccctgaactgctgaacgataagctgatgacttctacgattgt

SEQ ID NO: 1902 - DNA, 63 bp, Roseomonas mucosa strain SAVE376
  misc_feature (1)..(63): LLWF02000032.1/24311-24373 Roseomonas mucosa strain SAVE376 contig00032, whole genome shotgun sequence
gttcccgatggggatggggttcccccgaaaccgcccagatgggctgatgactcctaccgcaac

SEQ ID NO: 1903 - DNA, 77 bp, Intrasporangium chromatireducens Q5-1
  misc_feature (1)..(77): AWQS01000020.1/21083-21159 Intrasporangium chromatireducens Q5-1 contig28, whole genome shotgun sequence
tgtcgccacggcgatggatcccgccgggacgccacgcgcgcccgaaccgccacccggctgatggttcctgttcatca

SEQ ID NO: 1904 - DNA, 104 bp, Burkholderia cenocepacia J2315
  misc_feature (1)..(104): AM747721.1/913754-913857 Burkholderia cenocepacia J2315 chromosome 2, complete genome
gcggcctgcggagatggcatgcctccctgcggtcgttgccggcgcgtagcgcgcggtgcggccctcaaccgccggtttgcccggctgatgatgcctgcgtgttc

SEQ ID NO: 1905 - DNA, 63 bp, Geobacillus sp. BCO2
  misc_feature (1)..(63): LJAJ01000001.1/63803-63865 Geobacillus sp. BCO2 LR69_contig000001, whole genome shotgun sequence
aatcgaataggcgatggagttcgccataaccgccggcttccggctgatgactcctgctgcaga

SEQ ID NO: 1906 - DNA, 64 bp, Bosea sp. TND4EK4
  misc_feature (1)..(64): FTMO01000001.1/123874-123811 Bosea sp. TND4EK4 genome assembly, contig: Ga0136738_101
tgagccgatggggatggggttcccccgaaaccgcccttgaagggctgatgactcctgccgagcc

SEQ ID NO: 1907 - DNA, 77 bp, Eubacterium sp. CAG:38
  misc_feature (1)..(77): FR899336.1/4361-4285 Eubacterium sp. CAG:38 genomic scaffold, scf36
atagaacaagggaatgaagtactcccgaagtgaaaaacacttaaaccgcttattaagctgatgacttctgcgatgaa

SEQ ID NO: 1908 - DNA, 69 bp, Betaproteobacteria bacterium RIFCSPLOWO2_02_FULL_62_17
  misc_feature (1)..(69): MEQV01000269.1/20307-20375 Betaproteobacteria bacterium RIFCSPLOWO2_02_FULL_62_17 rifcsplowo2_02_scaffold_6838, whole genome shotgun sequence
tgattgtagggagatggcatacctcccgcaagaataaccgccgtctcggctgatgatgcctacaggatc

SEQ ID NO: 1909 - DNA, 74 bp, Holdemania filiformis DSM 12042
  misc_feature (1)..(74): GG657557.1/343061-343134 Holdemania filiformis DSM 12042 genomic scaffold Scfld6, whole genome shotgun sequence
taaaggacagggaatgatttctcccctggcaatccgcctaaaccgctgtttcagctgatgacttctatgtgttt

SEQ ID NO: 1910 - DNA, 67 bp, Candidatus Methanosphaerula palustris E1-9c
  misc_feature (1)..(67): CP001338.1/1058733-1058667 Candidatus Methanosphaerula palustris E1-9c, complete genome
cttcgtcagggtgatggggttcacccacaataaaccgcgtttcttcgctgatgacccctatccatca

SEQ ID NO: 1911 - DNA, 89 bp, Rhizobium lusitanum strain P1-7
  misc_feature (1)..(89): FMAF01000003.1/33283-33195 Rhizobium lusitanum strain P1-7 genome assembly, contig: Ga0061101_103
aaatccaacggtaatggatttctgccgggccatggtggccgaaccgctgccttgaattttccagggaagctgatgactcctactcaaag

SEQ ID NO: 1912 - DNA, 76 bp, Mycobacterium heraklionense strain Davo
  misc_feature (1)..(76): LDPO01000008.1/5770-5695 Mycobacterium heraklionense strain Davo contig_8, whole genome shotgun sequence
cttgagctcggcgatgggtcccgcccggaagctttgacttccgaaccgccacacggctgatggcccctgcgaacga

SEQ ID NO: 1913 - DNA, 61 bp, Planctomycetes bacterium RIFOXYB12_FULL_42_10; identical to SEQ ID NO: 651
  misc_feature (1)..(61): MHZC01000921.1/589-649 Planctomycetes bacterium RIFOXYB12_FULL_42_10 rifoxyb3_full_scaffold_5445_curated, whole genome shotgun sequence

SEQ ID NO: 1914 - DNA, 80 bp, Elusimicrobia bacterium CG1_02_56_21
  misc_feature (1)..(80): MNUR01000060.1/8249-8328 Elusimicrobia bacterium CG1_02_56_21 cg1_0.2_scaffold_1755_c, whole genome shotgun sequence
tacagtcaaggcgatgatgtccgccgccccgtgaccgcacgggggaaccgtccgaggggactaatgacctctaccttaag

SEQ ID NO: 1915 - DNA, 62 bp, Sphingobacterium psychroaquaticum strain DSM 22418
  misc_feature (1)..(62): FXAU01000001.1/1275664-1275725 Sphingobacterium psychroaquaticum strain DSM 22418 genome assembly, contig: LY64DRAFT_scaffold00001.1
ttaactataggcaatgatgtctgccttgaaccgctactggagctgatgacgtctactttgaa

SEQ ID NO: 1916 - DNA, 66 bp, Photobacterium jeanii strain R-40508 C1841
  misc_feature (1)..(66): LVHF01000010.1/260-325 Photobacterium jeanii strain R-40508 C1841, whole genome shotgun sequence
ccgatcacgggtgatggagttccacctttaaccgctcatcattgagataatgactcctgctgtagt

SEQ ID NO: 1917 - DNA, 65 bp, Thermincola sp. JR
  misc_feature (1)..(65): CP002028.1/579265-579329 Thermincola sp. JR, complete genome
tacaaaaaaggcgatggggctcgccttgaaccgctgtttttacagatgatggctcctactggctt

SEQ ID NO: 1918 - DNA, 75 bp, Olsenella umbonata strain DSM 22620
  misc_feature (1)..(75): LT629759.1/1456296-1456370 Olsenella umbonata strain DSM 22620 genome assembly, chromosome: I
tgttccgtgcggaatgaggttctccgcggggcagaagccccaaaccgccttcgggatgatgacctctgccactgt

SEQ ID NO: 1919 - DNA, 86 bp, Hydrogenobaculum sp. Y04AAS1
  misc_feature (1)..(86): CP001130.1/523442-523357 Hydrogenobaculum sp. Y04AAS1, complete genome
caggtttaaggagatggcgttctccttgatgctcataaaagcatcaaaaccgcctcacatataaggctaataacgcctacctgctc

SEQ ID NO: 1920 - DNA, 62 bp, Starkeya novella DSM 506
  misc_feature (1)..(62): CP002026.1/3910535-3910474 Starkeya novella DSM 506, complete genome
cctgtctgcgggaatggtgtctcccgtaaaaccgcgctgatgctgatgacgcctgcttttcg

SEQ ID NO: 1921 - DNA, 61 bp, Luteibacter yeojuensis strain SU11
  misc_feature (1)..(61): JZRB01000011.1/34318-34378 Luteibacter yeojuensis strain SU11 contig_11, whole genome shotgun sequence
gcggccgatgggaatggggcttcccgataaccgccagttggctgatagctcctgccgtagt

SEQ ID NO: 1922 - DNA, 70 bp, Filimonas lacunae strain DSM 21054
  misc_feature (1)..(70): FTOR01000005.1/380028-380097 Filimonas lacunae strain DSM 21054 genome assembly, contig: Ga0111651_105
tcgcagtaaggcgatggtgctccgccttatcaaccgccctaaccagagggacgatggcgcctgcaataac

SEQ ID NO: 1923 - DNA, 68 bp, Vibrio angustum S14 1099604003226
  misc_feature (1)..(68): CH902600.1/668074-668141 Vibrio angustum S14 1099604003226 genomic scaffold, whole genome shotgun sequence
tttatggcgggagatgatgttcctccttcaaccgcctttcaataaaggataatgacgtctaacaacat

SEQ ID NO: 1924 - DNA, 73 bp, Clostridium phytofermentans ISDg
  misc_feature (1)..(73): CP000885.1/3806199-3806127 Clostridium phytofermentans ISDg, complete genome
cttactgacgggaatgaagttctcccaaggttttacctaaactgcttataaagctgatgacttctgtgaatta

SEQ ID NO: 1925 - DNA, 61 bp, Mycobacterium sherrisii strain BC1_M4
  misc_feature (1)..(61): MIHC01000025.1/20762-20822 Mycobacterium sherrisii strain BC1_M4 PROKKA_contig000025, whole genome shotgun sequence
cgcggttacggcgatgaagctcgccgcaaccgccgcgccggctgatggcttctaccaacga

SEQ ID NO: 1926 - DNA, 71 bp, Planctomycetales bacterium 71-10
  misc_feature (1)..(71): MKTT01000036.1/28217-28147 Planctomycetales bacterium 71-10 scnpilot_p_inoc_scaffold_161, whole genome shotgun sequence
ttcgcggagggtgatggagttcacccgacgattggaccgcccctcgcggggctgatgactcctacctggag

SEQ ID NO: 1927 - DNA, 79 bp, Roseburia sp. CAG:309
  misc_feature (1)..(79): FR894075.1/2447-2525 Roseburia sp. CAG:309 genomic scaffold, scf388
atagaacaagggaatgaagttctccctaagtagttagatacttaaaccgcttataaaagctgatgacttctgcgatatt

SEQ ID NO: 1928 - DNA, 60 bp, Desulfotomaculum ruminis DSM 2154
  misc_feature (1)..(60): CP002780.1/1695616-1695675 Desulfotomaculum ruminis DSM 2154, complete genome
acaaataatggcgatggagctcgccataaccgcccttgggctaatggctcctacctagaa

SEQ ID NO: 1929 - DNA, 67 bp, Bacteroides coprosuis DSM 18011
  misc_feature (1)..(67): CM001167.1/2015568-2015502 Bacteroides coprosuis DSM 18011 chromosome, whole genome shotgun sequence
aagcaaatagggaatggaacttccctgtcataaaccgctaataatagctgatagttcctacgatatc

SEQ ID NO: 1930 - DNA, 62 bp, Bacterium UASB270
  misc_feature (1)..(62): DF820472.1/161849-161788 Bacterium UASB270 DNA, scaffold: UASB270_scaffold_10
atattttcaggtgatggagttcacctcgaaccgcatgttctgctaataactcctaccagttt

SEQ ID NO: 1931 - DNA, 64 bp, Candidatus Schekmanbacteria bacterium RIFCSPLOWO2_12_FULL_38_15; identical to SEQ ID NO: 224
  misc_feature (1)..(64): MGDI01000031.1/92400-92337 Candidatus Schekmanbacteria bacterium RIFCSPLOWO2_12_FULL_38_15 rifcsplowo2_12_scaffold_364, whole genome shotgun sequence

SEQ ID NO: 1932 - DNA, 61 bp, Desulfitobacterium hafniense Y51
  misc_feature (1)..(61): AP008230.1/2441450-2441510 Desulfitobacterium hafniense Y51 DNA, complete genome
aatcagataggcgatggagttcgcctttaaccgccgcttggctaatgactcctgccggtta

SEQ ID NO: 1933 - DNA, 60 bp, Clostridium paraputrificum strain 373-A1
  misc_feature (1)..(60): MAPZ01000011.1/252388-252329 Clostridium paraputrificum strain 373-A1 CP373A1_19, whole genome shotgun sequence
aataataagggcgatggagttcgccattaaatgctttatgctaatgactcctacaaagta

SEQ ID NO: 1934 - DNA, 60 bp, Clostridium botulinum B str. Eklund 17B
  misc_feature (1)..(60): CP001056.1/2720217-2720276 Clostridium botulinum B str. Eklund 17B, complete genome
atatatttaggtgatggagttcacctttaactgcgtaatgctaatgactcctacaaaaaa

SEQ ID NO: 1935 - DNA, 85 bp, Salinicola sp. MIT1003 NODE_31_length_23181_cov_92.2337_ID_61
  misc_feature (1)..(85): MCAP01000024.1/14886-14802 Salinicola sp. MIT1003 NODE_31_length_23181_cov_92.2337_ID_61, whole genome shotgun sequence
cttgccgtgggagatggcattcctcccgagcggccttctcgttcgctcgaaccaccgtctatcggttaatgatgcctgcgggcgc

SEQ ID NO: 1936 - DNA, 62 bp, Nitrospinae bacterium RIFCSPLOWO2_12_39_16
  misc_feature (1)..(62): MHDO01000021.1/4226-4165 Nitrospinae bacterium RIFCSPLOWO2_12_39_16 rifcsplowo2_12_sub10_scaffold_141, whole genome shotgun sequence
ttaaaaggaggtgatggagttcacctttaaccgccttaatggctgataactcctacaaattt

SEQ ID NO: 1937 - DNA, 73 bp, Ruminococcus sp. CAG:60
  misc_feature (1)..(73): HF990157.1/9033-9105 Ruminococcus sp. CAG:60 genomic scaffold, scf174
aataaaaaggggaatgaatgtctccccgggatcatcccgaaccgcttattaagctgatgacttctgtgataac

SEQ ID NO: 1938 - DNA, 90 bp, Anaerotruncus sp. CAG:390
  misc_feature (1)..(90): FR897630.1/11154-11065 Anaerotruncus sp. CAG:390 genomic scaffold, scf173
tatcgccgagggaatgaagttctcccgaagcaccggggcataagccccgtgcctgaaccgcttataaaagctgatgacttctgcattatt

SEQ ID NO: 1939 - DNA, 62 bp, Pediococcus claussenii ATCC BAA-344
  misc_feature (1)..(62): CP003137.1/1745706-1745645 Pediococcus claussenii ATCC BAA-344, complete genome
aatcgaatcggcgatgacgttcgccacaaaattataatttaattgatgacgtctaccacaag

SEQ ID NO: 1940 - DNA, 64 bp, Acidithiobacillus thiooxidans strain A02
  misc_feature (1)..(64): LWSA01000081.1/1744-1681 Acidithiobacillus thiooxidans strain A02 contig081, whole genome shotgun sequence
acaaattatggcgatggattccgcccaataaccgcctttataggctaatgactcctactgatcc

SEQ ID NO: 1941 - DNA, 62 bp, Mycobacterium sp. JDM601
  misc_feature (1)..(62): CP002329.1/931000-931061 Mycobacterium sp. JDM601, complete genome
gttgatggcggcgatgaagctcgccatgaaccgccgccccggctgatggcttctaccacgtg

SEQ ID NO: 1942 - DNA, 67 bp, Bacterium UASB270
  misc_feature (1)..(67): DF820472.1/161032-160966 Bacterium UASB270 DNA, scaffold: UASB270_scaffold_10
gatgagtaaggcaatgaagtctgcctgaacctcctggaatttccaggatgatgacttctattgtata

SEQ ID NO: 1943 - DNA, 74 bp, Vibrio sp. N418 VIBRN418_89
  misc_feature (1)..(74): AFWD01000095.1/32709-32782 Vibrio sp. N418 VIBRN418_89, whole genome shotgun sequence
tgcctacacggtgatggggttccaccgtggcctttcggtcaaaaccgcacgatgctgatgactcctacagaaac

SEQ ID NO: 1944 - DNA, 60 bp, Clostridium cadaveris strain NLAE-zl-G419
  misc_feature (1)..(60): FOOE01000004.1/180052-180111 Clostridium cadaveris strain NLAE-zl-G419 genome assembly, contig: Ga0070261_104
aaatataaaggtgaaggagttcacctataaatgctataagctgatgactcctataagata

SEQ ID NO: 1945 - DNA, 78 bp, Elusimicrobia bacterium GWA2_62_23
  misc_feature (1)..(78): MGTV01000029.1/111483-111406 Elusimicrobia bacterium GWA2_62_23 gwa2_scaffold_252, whole genome shotgun sequence
ttgaaccacggcgatgatgtccgccgccccggccccccgggggaaccgcgcgaaggcgctgatgacctctacccctca

SEQ ID NO: 1946 - DNA, 87 bp, Nocardia donostiensis strain X1655 2
  misc_feature (1)..(87): MUMY01000002.1/148269-148183 Nocardia donostiensis strain X1655 2, whole genome shotgun sequence
cttgtcgtcggcgatggatctccgccaaggcaccccaggtggtgtctgaaccgcctcgctgccggggctgatggttcctttctcgtc

SEQ ID NO: 1947 - DNA, 89 bp, Novosphingobium sp. AAP1
  misc_feature (1)..(89): LJHO01000001.1/467664-467576 Novosphingobium sp. AAP1 AAP1Contigs1, whole genome shotgun sequence
cgcggccaaggcgatggatttccgccgggcattttgccgaaccgcctgccgcgccaaacggcgccagggctgatgattcctacctgaaa

SEQ ID NO: 1948 - DNA, 108 bp, Burkholderia latens strain AU17928
  misc_feature (1)..(108): CP013438.1/500555-500662 Burkholderia latens strain AU17928 chromosome 2, complete sequence
gccgcctgcggagatggcatgcctccctgcggtcgagtccggcgcgtcgcgcgcgcggtcttcggccctcaaccgccggttcgcccggctgatgatgcctgcgtgttc

SEQ ID NO: 1949 - DNA, 64 bp, Lactobacillus oryzae
  misc_feature (1)..(64): BBJM01000037.1/4345-4282 Lactobacillus oryzae DNA, contig: sequence37, strain: SG293
aaatgaatcggcgatgacgttcgccattaataattgactatcaattgatgacgtctactgaatc

SEQ ID NO: 1950 - DNA, 68 bp, Spinacia oleracea cultivar SynViroflay
  misc_feature (1)..(68): AYZV02278730.1/438-505 Spinacia oleracea cultivar SynViroflay scaffold91480.con0027.1, whole genome shotgun sequence
tgaacaaaaggaaatggtgttcttccttacccaaccgctttacaaaagctgatgacgcctgattaaaa

SEQ ID NO: 1951 - DNA, 69 bp, Omnitrophica WOR_2 bacterium RIFCSPHIGHO2_02_FULL_50_17
  misc_feature (1)..(69): MHGQ01000025.1/13844-13776 Omnitrophica WOR_2 bacterium RIFCSPHIGHO2_02_FULL_50_17 rifcsphigho2_02_scaffold_1877, whole genome shotgun sequence
attttaaaaggcgatgaggttcgccaagactgcccggggataagtcgggatgataacctctgctggaaa

SEQ ID NO: 1952 - DNA, 74 bp, Thermoplasmatales archaeon I-plasma AMDU3_IPLC00004
  misc_feature (1)..(74): ATMD01000004.1/321499-321572 Thermoplasmatales archaeon I-plasma AMDU3_IPLC00004, whole genome shotgun sequence
catttgcaaggagatggaatcctccagcgctctctgggccgaactttctaatgaatgatgattcctgcttggag

SEQ ID NO: 1953 - DNA, 65 bp, Streptomyces sp. CB01249
  misc_feature (1)..(65): LISW01000001.1/1383979-1384043 Streptomyces sp. CB01249 scaffold1, whole genome shotgun sequence
atgcgtaccggtgatggggctcaccgaaaccgcggccgatggccgctgacggtccctggttgttt

SEQ ID NO: 1954 - DNA, 73 bp, Anaerococcus vaginalis ATCC 51170
  misc_feature (1)..(73): GG700527.1/977325-977253 Anaerococcus vaginalis ATCC 51170 genomic scaffold SCAFFOLD1, whole genome shotgun sequence
atactaaaagggaatgaagttctcccttagattatttctaaaaccgcattttgctgatgacttctgttactat

SEQ ID NO: 1955 - DNA, 62 bp, Alicyclobacillus sp. USBA-503
  misc_feature (1)..(62): FRAF01000007.1/62851-62790 Alicyclobacillus sp. USBA-503 genome assembly, contig: Ga0105849_107
aactgaacaggtgatggagcccaccttaaccgcctctataggataatagctcctacaaattt

SEQ ID NO: 1956 - DNA, 88 bp, Nocardia soli strain Y48
  misc_feature (1)..(88): CP018082.1/3527307-3527394 Nocardia soli strain Y48, complete genome
ctcttccgtggcgatggatctccgccgaggcagccccgtgggagtgtctgaaccgccccggaccggggctgatggttccttccctcgc

SEQ ID NO: 1957 - DNA, 76 bp, Niastella vici strain DJ57
  misc_feature (1)..(76): LVYD01000065.1/48506-48581 Niastella vici strain DJ57 contig36, whole genome shotgun sequence
caccacaaaggaaatggtgtcttcctatttgaaccgtcccgatgattaactaaggactgatggcgcctacaaatag

SEQ ID NO: 1958 - DNA, 63 bp, Mycobacterium sherrisii strain BC1_M4
  misc_feature (1)..(63): MIHC01000025.1/53604-53666 Mycobacterium sherrisii strain BC1_M4 PROKKA_contig000025, whole genome shotgun sequence
cccgcggctggcgatgaggctcgccactttcgcgcttatggcgctgatggcttctaccccgca

SEQ ID NO: 1959 - DNA, 69 bp, Pedobacter sp. BAL39 1103467000501; identical to SEQ ID NO: 955
  misc_feature (1)..(69): ABCM01000022.1/54798-54866 Pedobacter sp. BAL39 1103467000501, whole genome shotgun sequence

SEQ ID NO: 1960 - DNA, 66 bp, Acinetobacter gerneri DSM 14967
  misc_feature (1)..(66): KB849533.1/123115-123180 Acinetobacter gerneri DSM 14967 = CIP 107464 genomic scaffold acLZs-supercont1.27, whole genome shotgun sequence
tgaagcttaggagatggtattcctcccattacaaaccgcccttaggctgatgatacctacgtcttc

SEQ ID NO: 1961 - DNA, 75 bp, Roseburia sp. CAG:182
  misc_feature (1)..(75): FR903987.1/154-80 Roseburia sp. CAG:182 genomic scaffold, scf226
tttagaaaagggaatgaagttctccctcgattgatttcgaaaccgctgattcaggctgatgacttctgtgcattt

SEQ ID NO: 1962 - DNA, 70 bp, Candidatus Rokubacteria bacterium GWA2_70_23
  misc_feature (1)..(70): MGBT01000235.1/2204-2273 Candidatus Rokubacteria bacterium GWA2_70_23 gwa2_scaffold_94712, whole genome shotgun sequence
cggccacagggcgatggagttcgccctccccaaccgcctggcgtcacgggctgataactcctaccgaagc

SEQ ID NO: 1963 - DNA, 72 bp, Aeromicrobium sp. Root472D3
  misc_feature (1)..(72): LMET01000002.1/86989-87060 Aeromicrobium sp. Root472D3 contig_2, whole genome shotgun sequence
atcgaccttggcgatggaccccgcctgagtttcagactcgaaccgcattgtgctgatggctcctgctattcg

SEQ ID NO: 1964 - DNA, 72 bp, Clostridium sp. CAG:510
  misc_feature (1)..(72): FR880840.1/41178-41249 Clostridium sp. CAG:510 genomic scaffold, scf106
atgatttcagggaatgaagttctcccttgggaaacctaaaccgcttagtaagctgatgacttctgtgatgca

SEQ ID NO: 1965 - DNA, 75 bp, Mycobacterium ulcerans str. Harvey; identical to SEQ ID NO: 476
  misc_feature (1)..(75): JAOL01000124.1/37066-37140 Mycobacterium ulcerans str. Harvey Harvey.contig.123, whole genome shotgun sequence

SEQ ID NO: 1966 - DNA, 66 bp, Pedobacter sp. BAL39 1103467000516
  misc_feature (1)..(66): ABCM01000001.1/151944-151879 Pedobacter sp. BAL39 1103467000516, whole genome shotgun sequence
ttgcctaagggaaatggtgtccttccaatttaaccgcttttagaagctgatggcgcctgcaatgat

SEQ ID NO: 1967 - DNA, 89 bp, Methanobrevibacter sp. 87.7
  misc_feature (1)..(89): MRCT01000006.1/6591-6503 Methanobrevibacter sp. 87.7 contig6, whole genome shotgun sequence
ttataatttggtgatgaggttcgccatgtattaatttacagaaccgttaaactttttttaagatttaactgatgacttcctatttaact

SEQ ID NO: 1968 - DNA, 81 bp, Gluconobacter morbifer G707 75_5
  misc_feature (1)..(81): AGQV01000005.1/14506-14586 Gluconobacter morbifer G707 75_5, whole genome shotgun sequence
ttttgtagtggcaatggactctgcctgacctcattacgtcgaaccgcgatccttcggggcgctgatgattcctacctcgca

SEQ ID NO: 1969 - DNA, 68 bp, Enterococcus hirae ATCC 9790
  misc_feature (1)..(68): CP003504.1/1769319-1769386 Enterococcus hirae ATCC 9790, complete genome
aagtgaataggtgatggtgttcgcctttaaacgttaatcttaagataactaatgacgcctactaagaa

SEQ ID NO: 1970 - DNA, 59 bp, Caldanaerobius fijiensis DSM 17918
  misc_feature (1)..(59): FQVH01000038.1/5568-5626 Caldanaerobius fijiensis DSM 17918 genome assembly, contig: EJ21DRAFT_scaffold00038.38
tataaatatggtgatggggctcaccttaaatgcgaaatgctaatggctcctactttgat

SEQ ID NO: 1971 - DNA, 68 bp, Enterococcus faecalis 13-SD-W-01
  misc_feature (1)..(68): KE351688.1/3523-3456 Enterococcus faecalis 13-SD-W-01 genomic scaffold Scaffold959, whole genome shotgun sequence
aaggaataaggtgatggtgttcgcctttaaacgttgatcgaaagacagctaatgacgcctactagaga

SEQ ID NO: 1972 - DNA, 69 bp, Chryseobacterium takakiae strain DSM 26898
  misc_feature (1)..(69): FQVO01000006.1/133983-133915 Chryseobacterium takakiae strain DSM 26898 genome assembly, contig: Ga0131160_106
ctaacaaaaggaaatggtgttcttccttacccaaccgcttttcagaaagctgatgacgcctgattaaaa

SEQ ID NO: 1973 - DNA, 71 bp, Lentisphaerae bacterium GWF2_52_8
  misc_feature (1)..(71): MHBJ01000043.1/8102-8172 Lentisphaerae bacterium GWF2_52_8 gwf2_scaffold_14617, whole genome shotgun sequence
aaataaaaaggctatgaggtcagccgaaaccgtctgagcgaagaactcggaatgatgacttctatttaggg

SEQ ID NO: 1974 - DNA, 74 bp, [Clostridium] celerecrescens strain 152B c10
  misc_feature (1)..(74): JPME01000010.1/357217-357144 [Clostridium] celerecrescens strain 152B c10, whole genome shotgun sequence
ttgagaaaagggaatgaagctctcccatgatagaattatcaaaaccgcaatttgctgatggcttctgtatattt

SEQ ID NO: 1975 - DNA, 106 bp, Burkholderia sp. A9
  misc_feature (1)..(106): JSZN01000007.1/281463-281358 Burkholderia sp. A9 Contig7, whole genome shotgun sequence
gcgccctgcggagatggcatgcctccctgcggtcgatcccggcgcgtggcgcgtgcggtgcggccctcaaccgccgggttgcccggctgatgatgcctgcgtgttc

SEQ ID NO: 1976 - DNA, 61 bp, Deltaproteobacteria bacterium RBG_19FT_COMBO_46_12
  misc_feature (1)..(61): MGRA01000126.1/1306-1246 Deltaproteobacteria bacterium RBG_19FT_COMBO_46_12 rbg_19ft_combo_scaffold_1869, whole genome shotgun sequence
gattgatgtggcgatggagtccgccggaaccgccttcttggctgatggctcctatcaaann

SEQ ID NO: 1977 - DNA, 75 bp, Thiomonas bhubaneswarensis strain DSM 18181
  misc_feature (1)..(75): CYHF01000010.1/53222-53296 Thiomonas bhubaneswarensis strain DSM 18181 genome assembly, contig: Ga0061069_110
acatcaaacggcgatggagttcgccgttcaaatgcctctgagggcttgccccgggctgatgactcctacccgtct

SEQ ID NO: 1978 - DNA, 74 bp, Pandoraea thiooxydans strain DSM 25325
  misc_feature (1)..(74): CP011568.2/1647342-1647269 Pandoraea thiooxydans strain DSM 25325, complete genome
ctcgcggcaggagatggcatgcctcctttaaccgccaccggcctcgtgccggggctgatgatgcctacgcaacc

SEQ ID NO: 1979 - DNA, 62 bp, Mycobacterium sp. 1245111.1
  misc_feature (1)..(62): LZLV01000067.1/32325-32264 Mycobacterium sp. 1245111.1 contig_159, whole genome shotgun sequence
tcccgttcaggcgatgaagcccgccttcaactgccgcaacggctgatggcttctacccgtcc

SEQ ID NO: 1980 - DNA, 60 bp, Clostridium saccharobutylicum DSM 13864
  misc_feature (1)..(60): CP006721.1/3419704-3419763 Clostridium saccharobutylicum DSM 13864, complete genome
tatatttcaggtgatggagttcgcctttaactgcgtaatgctaatgactcctacaaaata

SEQ ID NO: 1981 - DNA, 88 bp, Mycobacterium neoaurum VKM Ac-1815D
  misc_feature (1)..(88): CP006936.1/2090582-2090495 Mycobacterium neoaurum VKM Ac-1815D, complete genome
ctcgacgacggcgatggatctccgccgagacgcccggtgacaggtgtctgaaccgcctcgtccggaggctgatggctcctttccccga

SEQ ID NO: 1982 - DNA, 76 bp, Firmicutes bacterium CAG:145
  misc_feature (1)..(76): FR882595.1/181344-181419 Firmicutes bacterium CAG:145 genomic scaffold, scf50
attgcttaagggaaagaggttctcccatggcgtgacttgcctgaactgccgaaaggctgatgacttctgcaatcgc

SEQ ID NO: 1983 - DNA, 73 bp, Acidobacteria bacterium RIFCSPLOWO2_02_FULL_61_28
  misc_feature (1)..(73): MEKR01000017.1/22217-22145 Acidobacteria bacterium RIFCSPLOWO2_02_FULL_61_28 rifcsplowo2_02_scaffold_11887, whole genome shotgun sequence
atgaatcttggcgatggagttcgccctcaaccgcccagaggactgctgacgggctgatgactcctacctaact

SEQ ID NO: 1984 - DNA, 104 bp, Rhodanobacter sp. FW510-R10 contig112
  misc_feature (1)..(104): LVJU01000016.1/2690-2587 Rhodanobacter sp. FW510-R10 contig112, whole genome shotgun sequence
tggccgctcggagatggcatgcctcccgttccggcaccttcggatgcgccgggacaaaccgctactcgtgatcccgcgttgaagctgatgatgcctgcacctcc

SEQ ID NO: 1985 - DNA, 62 bp, Desulfotomaculum sp. 46_80
  misc_feature (1)..(62): LGGF01000044.1/13727-13666 Desulfotomaculum sp. 46_80 MPI_scaffold_814, whole genome shotgun sequence
attataaaaggtgatggggttccgccggaaatacctgattggttgatgactcctgctatgga

SEQ ID NO: 1986 - DNA, 61 bp, Clostridium pasteurianum DSM 525
  misc_feature (1)..(61): CP009268.1/2643261-2643201 Clostridium pasteurianum DSM 525 = ATCC 6013, complete genome
gtaaaaataggtgatggagttcacctttaagtgctgaaatgctgatgactcctacagattt

SEQ ID NO: 1987 - DNA, 67 bp, Pontibacter ummariensis strain NKM1
  misc_feature (1)..(67): FZOQ01000002.1/203758-203692 Pontibacter ummariensis strain NKM1 genome assembly, contig: Ga0139000_102
gtattacatggtgatggggtaccaccagaaaccgcctaaagcaaaggctgatgactcctacatgaag

SEQ ID NO: 1988 - DNA, 77 bp, Sphingomonas sp. Leaf9; identical to SEQ ID NO: 1236
  misc_feature (1)..(77): LMKC01000001.1/301789-301865 Sphingomonas sp. Leaf9 contig_1, whole genome shotgun sequence

SEQ ID NO: 1989 - RNA, 62 nt, Artificial sequence
  Synthetic Polynucleotide
uggcggucuggggguggaguuccccauaaccgcccacccgggccgaugacuccuaccgcgug

SEQ ID NO: 1990 - RNA, 61 nt, Artificial sequence
  Synthetic Polynucleotide
auugaaugaggcgauggaguucgccauaaccgcuuccauagcuaaugacuccuaccagagg

SEQ ID NO: 1991 - RNA, 74 nt, Artificial sequence
  Synthetic Polynucleotide
guaugaaacgggaaugagguucucccacgauuaauucgaaaccgcuaaauuuagcugaugacuucuguguagac

SEQ ID NO: 1992 - RNA, 78 nt, Artificial sequence
  Synthetic Polynucleotide
uauagacaagguaauggaaucuaccugauccuuucuauggaucgaaccgcccuuuaggcugaugacuccugcucaaac

SEQ ID NO: 1993 - RNA, 76 nt, Artificial sequence
  Synthetic Polynucleotide
guuuagucgggcgauggcguccgcccgggcuucgagcccgaaccgcccguuaagggcugaugacgccuguucuacc

SEQ ID NO: 1994 - RNA, 68 nt, Artificial sequence
  Synthetic Polynucleotide
auuuauuugggagauggcauuccuccuacccaaaccguccauauuggacugaugaugccuacguaaac

SEQ ID NO: 1995 - RNA, 63 nt, Artificial sequence
  Synthetic Polynucleotide
gcaagaucuggagaugacauuccuccauaaccgcccuucaaggcugaugaugucuacguaacc

SEQ ID NO: 1996 - RNA, 66 nt, Artificial sequence
  Synthetic Polynucleotide
aaguuaaucggcgaugacguucgccacauaauaauugauaaucaauuugaugacgucuacuguuug

SEQ ID NO: 1997 - RNA, 61 nt, Artificial sequence
  Synthetic Polynucleotide
agugaauaaggcgauggaguucgccauuaaccgccugcgggcuaaugacuccuaccaaugu

SEQ ID NO: 1998 - RNA, 60 nt, Artificial sequence
  Synthetic Polynucleotide
agaguaauaggcgauggaguucgcuaaacuaucguucgggcugaugacuccuaccaguaa

SEQ ID NO: 1999 - DNA, 62 bp, Aquamicrobium defluvii strain W13Z1
  misc_feature (1)..(62): KK073879.1/66063-66124 Aquamicrobium defluvii strain W13Z1 genomic scaffold V9__scaffold_03, whole genome shotgun sequence
taaatggatggggatggagctccccgaaaccgcctgaaatggctgatggctcctgtcgcaac

SEQ ID NO: 2000 - DNA, 58 bp, Desulfotomaculum acetoxidans DSM 771
  misc_feature (1)..(58): CP001720.1/2367796-2367739 Desulfotomaculum acetoxidans DSM 771, complete genome
taactttatggcgatggagttcgcctaatgctgtgaagctaatggctcctacctgaca

SEQ ID NO: 2001 - DNA, 64 bp, Alicyclobacillus sp. USBA-503
  misc_feature (1)..(64): FRAF01000024.1/35081-35018 Alicyclobacillus sp. USBA-503 genome assembly, contig: Ga0105849_124
agtgatatcggtgatggagctcaccagaaagcctctacaagaggatgatggctcctgcaaaagc

SEQ ID NO: 2002 - DNA, 64 bp, Clostridium sp. W14A NODE_46
  misc_feature (1)..(64): MBSV01000068.1/14235-14298 Clostridium sp. W14A NODE_46, whole genome shotgun sequence
aattaaaacggcgatgaagttcgccttttatcccagctccggggttaatgacttctattatttt

SEQ ID NO: 2003 - DNA, 116 bp, Treponema brennaborense DSM 12168
  misc_feature (1)..(116): CP002696.1/200047-200162 Treponema brennaborense DSM 12168, complete genome
agttgaatcgggaatgaagttctcccgaggaaaatcctgaaccgggaccggccgccgcgctgcagaacgtaactgcgcacgcacggcgcgcggtctctgatgacttctgtgattac

SEQ ID NO: 2004 - DNA, 71 bp, Xanthomonas translucens pv. undulosa strain Xtu 4699
  misc_feature (1)..(71): CP008714.1/2345838-2345768 Xanthomonas translucens pv. undulosa strain Xtu 4699, complete genome
gcgcccacaggagatggcgttcctccttcaaccactgtgccgacggcgcagttgatgacgcctacagacac

SEQ ID NO: 2005 - DNA, 85 bp, Oscillatoria acuminata PCC 6304
  misc_feature (1)..(85): CP003607.1/3969870-3969954 Oscillatoria acuminata PCC 6304, complete genome
aagattgaaggcgatggagctcgccataaccgccgattcagcgatcccgatgggaggctgaagggctgatggctcctacctgtcc

SEQ ID NO: 2006 - DNA, 69 bp, Providencia rettgeri strain MR4; identical to SEQ ID NO: 262
  misc_feature (1)..(69): LCVM01000143.1/4442-4374 Providencia rettgeri strain MR4 P_rettgeri_contig_143, whole genome shotgun sequence

SEQ ID NO: 2007 - DNA, 68 bp, Halothiobacillus neapolitanus c2
  misc_feature (1)..(68): CP001801.1/1928728-1928661 Halothiobacillus neapolitanus c2, complete genome
caacgaaatggcgatggagttcgccgtaaccgcccccacttctggtggctgatgactcctgaaggcgc

SEQ ID NO: 2008 - DNA, 62 bp, Paeniclostridium sordellii ATCC 9714; identical to SEQ ID NO: 847
  misc_feature (1)..(62): APWR01000094.1/18921-18860 Paeniclostridium sordellii ATCC 9714 gcs9714.contig.94, whole genome shotgun sequence

SEQ ID NO: 2009 - DNA, 59 bp, Caloramator quimbayensis strain USBA 833
  misc_feature (1)..(59): FUYH01000022.1/42644-42702 Caloramator quimbayensis strain USBA 833 genome assembly, contig: Ga0105845_122
cgtaattttggtgatggagttcgccataaatgctttaagctgatgactcctgcaaataa

SEQ ID NO: 2010 - DNA, 59 bp, Bacteroidetes bacterium GWA2_32_17
  misc_feature (1)..(59): MENF01000040.1/1522-1464 Bacteroidetes bacterium GWA2_32_17 gwa2_scaffold_14764, whole genome shotgun sequence
aaatattttggcgatggagttcgccataaaccgcataagctaatgactcctactaattt

SEQ ID NO: 2011 - DNA, 72 bp, Ferrovum sp. JA12
  misc_feature (1)..(72): LJWX01000002.1/320404-320475 Ferrovum sp. JA12 FERRO_contig000002, whole genome shotgun sequence
tgagtcacaggaaatggcattttcctactcaaccgcctgcttaaagtcaaggctgataatgcctacaatttt

SEQ ID NO: 2012 - DNA, 74 bp, Thermococcus pacificus strain P-4
  misc_feature (1)..(74): CP015102.1/1424415-1424488 Thermococcus pacificus strain P-4, complete genome
ggttccatgggcgatggcgtccgcccgggcttcgagccgaaccgccctcatgggctgatgacgcctgttctccg

SEQ ID NO: 2013 - DNA, 77 bp, Sphingomonas sp. Leaf17; identical to SEQ ID NO: 1716
  misc_feature (1)..(77): LMKL01000002.1/3129-3053 Sphingomonas sp. Leaf17 contig_10, whole genome shotgun sequence

SEQ ID NO: 2014 - DNA, 62 bp, Desulfovibrio mexicanus strain DSM 13116
  misc_feature (1)..(62): FZOC01000008.1/20850-20911 Desulfovibrio mexicanus strain DSM 13116 genome assembly, contig: Ga0070557_108
gatggctcaggggatggagtcccccgtgaaccgcgacaaccgctgacgactcctgccgccga

SEQ ID NO: 2015 - DNA, 73 bp, Natrialba asiatica DSM 12278
  misc_feature (1)..(73): AOIO01000039.1/19717-19789 Natrialba asiatica DSM 12278 contig_39, whole genome shotgun sequence
cccccttcgggcgatggggcccgcccgacccaaccgccggcaccgaccgccggctgacggtccctgccactac

SEQ ID NO: 2016 - DNA, 61 bp, Bacillus sp. 2_A_57_CT2
  misc_feature (1)..(61): GL635751.1/207851-207791 Bacillus sp. 2_A_57_CT2 genomic scaffold supercont1.2, whole genome shotgun sequence
aaaataataggtgatggagttcacctttaaccgcctttaggctaatgactcctgtcagttg

SEQ ID NO: 2017 - DNA, 77 bp, Hadesarchaea archaeon YNP_N21
  misc_feature (1)..(77): LQMP01000030.1/18008-18084 Hadesarchaea archaeon YNP_N21 contig_4, whole genome shotgun sequence
aagaaaaaaggcgatggagctcgccgttaaccgctcctgctttgcattatgcgggggctgatagctcctacttttcg

SEQ ID NO: 2018 - DNA, 79 bp, Sebaldella termitidis ATCC 33386
  misc_feature (1)..(79): CP001739.1/594403-594325 Sebaldella termitidis ATCC 33386, complete genome
attaaaaaaggagatgaagctctccgtagtataaaaactaaaactacaattatagattgttaatagcttctgcagtatt

SEQ ID NO: 2019 - DNA, 60 bp, Bacillus thuringiensis serovar israelensis ATCC 35646 sq1863
  misc_feature (1)..(60): AAJM01000092.1/4654-4595 Bacillus thuringiensis serovar israelensis ATCC 35646 sq1863, whole genome shotgun sequence
ataatcagaggcgatggagttcgccataactgctgcttagctaatgactcctaccagtat

SEQ ID NO: 2020 - DNA, 69 bp, Haladaptatus sp. R4
  misc_feature (1)..(69): LWHG01000021.1/731273-731341 Haladaptatus sp. R4 NODE_2_length_1049977_cov_26.4246_ID_1027, whole genome shotgun sequence
gactaaccgggcgatggagtccgcctcccccaaccgccgaacacgtcggctgatgactccttttcgaga

SEQ ID NO: 2021 - DNA, 62 bp, Rhizobiales bacterium 65-9
  misc_feature (1)..(62): MKVY01000039.1/120888-120949 Rhizobiales bacterium 65-9 SCNpilot_cont_300_bf_scaffold_522, whole genome shotgun sequence
cgggccgatggggatggagtcccccgaaaccgcccgagagggctgatgactcctgccgcagt

SEQ ID NO: 2022 - DNA, 72 bp, Enterococcus columbae DSM 7374
  misc_feature (1)..(72): KE136492.1/346941-347012 Enterococcus columbae DSM 7374 = ATCC 51263 genomic scaffold acyDG-supercont2.2, whole genome shotgun sequence
atacgaacagggaatgaagttctcccttgggtaaccaaaaccgcgtaaaacgctgatgacttctatggcttt

SEQ ID NO: 2023 - DNA, 80 bp, Metallosphaera yellowstonensis MK1
  misc_feature (1)..(80): JH597761.1/584494-584415 Metallosphaera yellowstonensis MK1 genomic scaffold MetMK1scaffold_10, whole genome shotgun sequence
aagaggacgggggatggcgtccccctgggctcatagcccaaaccgccggaatcatgagggctgatgacgcctatctcatg

SEQ ID NO: 2024 - DNA, 65 bp, Emticicia oligotrophica DSM 17448
  misc_feature (1)..(65): CP002962.1/126944-127008 Emticicia oligotrophica DSM 17448 plasmid pEMTOL01, complete sequence
gccacatttggcaatgatgtctgccttgaaccgcctcatttgaggctgatggcgtctgtttctga

SEQ ID NO: 2025 - DNA, 59 bp, Thermovenabulum gondwanense strain R270
  misc_feature (1)..(59): LOHZ01000033.1/40695-40753 Thermovenabulum gondwanense strain R270 ATZ99_contig000034, whole genome shotgun sequence
taaaagtatggtgatggagctcaccataaaagcagtatgctgatggctcctgctatatc

SEQ ID NO: 2026 - DNA, 74 bp, Elusimicrobia bacterium RIFOXYA2_FULL_53_38
  misc_feature (1)..(74): MGVG01000006.1/24302-24229 Elusimicrobia bacterium RIFOXYA2_FULL_53_38 rifoxya2_full_scaffold_138, whole genome shotgun sequence
tattgtggaggctatgaggttcgccttggatatttctgaaactgccttaatgggctgagaacctctaccgtgaa

SEQ ID NO: 2027 - DNA, 70 bp, Lactobacillus vini DSM 20605
  misc_feature (1)..(70): AYYX01000035.1/18045-17976 Lactobacillus vini DSM 20605 Scaffold35, whole genome shotgun sequence
tgaaataaaggtgatgacgttcacctattaaatgatcgtaagcaaatgacctgatgacgtctactaaact

SEQ ID NO: 2028 - DNA, 86 bp, Phascolarctobacterium sp. CAG:207
  misc_feature (1)..(86): FR885232.1/633-718 Phascolarctobacterium sp. CAG:207 genomic scaffold, scf110
gtaataaaagggaatggggtactccctaaatgactttagtcgtttgaaccgcttagagttgataagctgatgacttctgccgtgta

SEQ ID NO: 2029 - DNA, 67 bp, Deltaproteobacteria bacterium RIFOXYD12_FULL_56_24
  misc_feature (1)..(67): MGTD01000007.1/168961-168895 Deltaproteobacteria bacterium RIFOXYD12_FULL_56_24 rifoxyd3_full_scaffold_128, whole genome shotgun sequence
cacaatgatggcgatggagttcgcctttgcgcgcttccccgacgaagctaatgactcctactcttga

SEQ ID NO: 2030 - DNA, 65 bp, Desulfobulbaceae bacterium DB1
  misc_feature (1)..(65): MQUF01000018.1/20436-20372 Desulfobulbaceae bacterium DB1 DB1_contig_18, whole genome shotgun sequence
aaatattaaggcgatggagttcgccattaaccgcttgcctgcaagctgatgactcctgccctccg

SEQ ID NO: 2031 - DNA, 62 bp, Methanomicrobiales archaeon 53_19
  misc_feature (1)..(62): LGHF01000110.1/169-230 Methanomicrobiales archaeon 53_19 MPJ_scaffold_3394, whole genome shotgun sequence
tcagatgcaggcgatgaagtccacctccatccgctgacgaggccgatgacttctacacctcg

SEQ ID NO: 2032 - DNA, 69 bp, Desulfacinum infernum DSM 9756
  misc_feature (1)..(69): FQVB01000016.1/92143-92211 Desulfacinum infernum DSM 9756 genome assembly, contig: EJ47DRAFT_scaffold00014.14
cagagaaaaggcaatgaagtctgcctgaaccacctgcgcccggcgccggttgatgacttctacctcagg

SEQ ID NO: 2033 - DNA, 60 bp, Bellilinea caldifistulae strain GOMI-1
  misc_feature (1)..(60): LGHJ01000002.1/27361-27302 Bellilinea caldifistulae strain GOMI-1 contig_21, whole genome shotgun sequence
attcacaaaagcgatgaggctcgctttaaccgtcgaatgactgatagcctctactgaatc

SEQ ID NO: 2034 - DNA, 64 bp, Bacteroidetes bacterium 4484_276
  misc_feature (1)..(64): NATG01000104.1/9296-9233 Bacteroidetes bacterium 4484_276 ex4484_276_scaffold_6541, whole genome shotgun sequence
ttcgccattggcgatggagttcgccataaaatgtcataaacggactgatgacccctttaataat

SEQ ID NO: 2035 - DNA, 73 bp, Sphingobacteriales bacterium 40-81
  misc_feature (1)..(73): MKWF01000046.1/267110-267182 Sphingobacteriales bacterium 40-81 SCNpilot_expt_1000_bf_scaffold_30, whole genome shotgun sequence
tgcggcaaaggaaatggtgtcttcctatttgaaccgtcccgctaaaggcaggactgatggcgcctacagatta

SEQ ID NO: 2036 - DNA, 61 bp, Pseudothermotoga thermarum DSM 5069
  misc_feature (1)..(61): CP002351.1/1604059-1603999 Pseudothermotoga thermarum DSM 5069 chromosome, complete genome
agttttatcggcgatggagtccgccgtaaaatgccgtaaggctgatgactcctacccaatt

SEQ ID NO: 2037 - DNA, 63 bp, Pseudonocardia sp. CNS-139
  misc_feature (1)..(63): MKJX01000184.1/170251-170189 Pseudonocardia sp. CNS-139 NODE_3_length_171736_cov_120.769_ID_221, whole genome shotgun sequence
ccggccacaggcgatggggctcgccttcgaccgcccgcccgggctgacggctcctaccgacag

SEQ ID NO: 2038 - DNA, 65 bp, Lactobacillus suebicus DSM 5007
  misc_feature (1)..(65): AZGF01000012.1/7088-7152 Lactobacillus suebicus DSM 5007 = KCTC 3549 strain DSM 5007 Scaffold12, whole genome shotgun sequence
aattaaataggcgatgacgttcgccgtaattaaactgattgtaatctgatgacgtctactattcc

SEQ ID NO: 2039 - DNA, 72 bp, Clostridiales genomosp. BVAB3 str. UPII9-5
  misc_feature (1)..(72): CP001850.2/690883-690954 Clostridiales genomosp. BVAB3 str. UPII9-5, complete genome
atgaaaaaagggaatgaagttctcccttgggcaacctgaaccgctttttaagctgatgacttctgcgataaa

SEQ ID NO: 2040 - DNA, 65 bp, Acidibacillus ferrooxidans strain ITV001
  misc_feature (1)..(65): LPVJ01000070.1/129704-129768 Acidibacillus ferrooxidans strain ITV001 contig0088, whole genome shotgun sequence
acaaaaatgggtgatggagctcacccaaactgccctcaccaagggataatggctcctgcgaatcg

SEQ ID NO: 2041 - DNA, 66 bp, Rhodanobacter sp. SCN 66-43
  misc_feature (1)..(66): MEGK01000014.1/76455-76520 Rhodanobacter sp. SCN 66-43 ABT18_C0014, whole genome shotgun sequence
ggggtttcaagagatggcatgcctctttgaaccgccggcgatccggctgatgatgcctacccaccg

SEQ ID NO: 2042 - DNA, 80 bp, Deltaproteobacteria bacterium RBG_13_58_19
  misc_feature (1)..(80): MGQI01000010.1/5321-5400 Deltaproteobacteria bacterium RBG_13_58_19 RBG_13_scaffold_11141, whole genome shotgun sequence
ctttaatatggcgatggagtccgccggggtggaggtggcatcacccaaaccgcattgacgctgatggctcctgatctcac

SEQ ID NO: 2043 - DNA, 111 bp, Natrinema sp. J7-2
  misc_feature (1)..(111): CP003412.1/181993-182103 Natrinema sp. J7-2, complete genome
aaacgaccgggcgatggggcccgcccgacccaaccgccgacagcgacgtcgaccgcgtctggagcgcacagacttaccgagcgtcgttcggctgacggtccctgcgtgagt

SEQ ID NO: 2044 - DNA, 60 bp, Bacillus cereus Rock4-18
  misc_feature (1)..(60): CM000735.1/4744050-4743991 Bacillus cereus Rock4-18 chromosome, whole genome shotgun sequence
ataattataggcgatggagttcgccataaccgctgcttagctaatgactcctatcagtat

SEQ ID NO: 2045 - DNA, 76 bp, Ensifer sp. YIC4027 C593
  misc_feature (1)..(76): LYBW01000040.1/63579-63504 Ensifer sp. YIC4027 C593, whole genome shotgun sequence
tggcacgttggcaatggattctgccaggcatcgagccgaaccgcttccccacgaagctgatgactcctgctcatga

SEQ ID NO: 2046 - DNA, 62 bp, Pseudomonas sp. HPB0071
  misc_feature (1)..(62): KI517368.1/144871-144810 Pseudomonas sp. HPB0071 genomic scaffold aczIi-supercont1.2, whole genome shotgun sequence
tggtgtacaggagatggtatttctcctttaactgctcttggggtaatgatgcctaagaaccc

SEQ ID NO: 2047 - DNA, 77 bp, Blautia sp. CAG:257
  misc_feature (1)..(77): HF999089.1/3110-3034 Blautia sp. CAG:257 genomic scaffold, scf163
attttattggggaatgaatgtctccctaagtattaatacttaaaccgcttagaaaagctgatgacttctgcaatcaa

SEQ ID NO: 2048 - DNA, 75 bp, Micrococcales bacterium 73-15
  misc_feature (1)..(75): MKVO01000004.1/560861-560787 Micrococcales bacterium 73-15 SCNpilot_expt_1000_bf_scaffold_204, whole genome shotgun sequence
tgacgacacggcgatggcgctcgccggggcagacagcccgaaccgccgttctcggctgatagcacctgtgacgag

SEQ ID NO: 2049 - DNA, 63 bp, Deltaproteobacteria bacterium RBG_13_51_10
  misc_feature (1)..(63): MGQE01000007.1/13655-13593 Deltaproteobacteria bacterium RBG_13_51_10 RBG_13_scaffold_11549_curated, whole genome shotgun sequence
gatacaaatggtgatggagttcaccattgaaccgcccgcgaggctgataactcctgtttttag

SEQ ID NO: 2050 - DNA, 58 bp, Desulfotomaculum putei DSM 12395
  misc_feature (1)..(58): FQUY01000004.1/108760-108703 Desulfotomaculum putei DSM 12395 genome assembly, contig: EJ51DRAFT_scaffold00004.4
aaattgaacggcgatggagttcgcctaacgctgccaagctgatgactcctacccttgt

SEQ ID NO: 2051 - DNA, 76 bp, Mesotoga prima MesG1.Ag.4.2
  misc_feature (1)..(76): CP003532.1/60231-60156 Mesotoga prima MesG1.Ag.4.2, complete genome
gattctctaggcaatgaagcttgccttggagaacaatcctccagaaccgccaccagctaatagcttctaccaaaat

SEQ ID NO: 2052 - DNA, 61 bp, Leptolinea tardivitalis strain YMTK-2
  misc_feature (1)..(61): LGCK01000010.1/389365-389305 Leptolinea tardivitalis strain YMTK-2 contig_3, whole genome shotgun sequence
atttccgttggtgatgaggctcacccgaaaccgtcctttgactgatagcctctactgaatt

SEQ ID NO: 2053 - DNA, 61 bp, Geobacillus caldoxylosilyticus NBRC 107762
  misc_feature (1)..(61): BAWO01000010.1/58961-58901 Geobacillus caldoxylosilyticus NBRC 107762 DNA, contig: GCA01S010
agtgtaataggcgatggagttctcctaaacttcctttcgggctgatggctcctaccaatga

SEQ ID NO: 2054 - DNA, 66 bp, Chryseobacterium formosense strain LMG 24722
  misc_feature (1)..(66): JPRP01000001.1/2233190-2233125 Chryseobacterium formosense strain LMG 24722 contig01, whole genome shotgun sequence
ttcgaaaaaggaaatggtgtcttccttacccaaccgccttaaaaagctgatggcgcctgattaatt

SEQ ID NO: 2055 - DNA, 65 bp, Spirochaetes bacterium RBG_16_67_19
  misc_feature (1)..(65): MIBK01000196.1/1903-1839 Spirochaetes bacterium RBG_16_67_19 RBG_16_scaffold_64826, whole genome shotgun sequence
tgctggcctggggatggagtcccccgcataaatacccaccaagggctgatgactcctacgacgca

SEQ ID NO: 2056 - DNA, 87 bp, Chloroflexi bacterium RBG_16_51_9
  misc_feature (1)..(87): MGNM01000040.1/11337-11423 Chloroflexi bacterium RBG_16_51_9 RBG_16_scaffold_21187, whole genome shotgun sequence
ttgtttagtggtgatgaagctcgccaaggattatctttaatttcctgaaccgtccttctaagaaggtctgatagcttctactggctt

SEQ ID NO: 2057 - DNA, 68 bp, Chryseobacterium soli strain DSM 19298
  misc_feature (1)..(68): JPRH01000001.1/1006855-1006788 Chryseobacterium soli strain DSM 19298 Contig01, whole genome shotgun sequence
caggatcaaggaaatggtgttcttccttccccaaccgctttacaaaagctgatgacgcctgattaaca

SEQ ID NO: 2058 - DNA, 68 bp, Flavisolibacter tropicus strain LCS9
  misc_feature (1)..(68): CP011390.1/2573175-2573108 Flavisolibacter tropicus strain LCS9, complete genome
ctatatacaggaaatggtgtcttcctgccccaaccgcttcttctaaagctaatggcgcctacaagtag

SEQ ID NO: 2059 - DNA, 63 bp, Desulfovibrio bizertensis DSM 18034
  misc_feature (1)..(63): FUYA01000003.1/163995-163933 Desulfovibrio bizertensis DSM 18034 genome assembly, contig: BR26DRAFT_scaffold00003.3
tcaaacttcggggatgaagtcccccgtgtaactgctcgatgagctgatgacttctgctgtgaa

SEQ ID NO: 2060 - DNA, 69 bp, Microgenomates (Woesebacteria) bacterium GW2011_GWC1_38_13
  misc_feature (1)..(69): LBUE01000009.1/8013-7945 Microgenomates (Woesebacteria) bacterium GW2011_GWC1_38_13 US75_C0009, whole genome shotgun sequence
gaagctataagcgatgaggctcgctatacaaccgctaaaactcctttagctgatagcttctacaaattt

SEQ ID NO: 2061 - DNA, 62 bp, Planctomycetes bacterium RIFOXYD12_FULL_42_12; identical to SEQ ID NO: 487
  misc_feature (1)..(62): MHZE01000558.1/428-489 Planctomycetes bacterium RIFOXYD12_FULL_42_12 rifoxyd3_full_scaffold_33258_curated, whole genome shotgun sequence

SEQ ID NO: 2062 - DNA, 62 bp, Archaeoglobus sulfaticallidus PM70-1
  misc_feature (1)..(62): CP005290.1/1481651-1481590 Archaeoglobus sulfaticallidus PM70-1, complete genome
aaagagaaaggtgatggcgttcacctctaactgccgtaaaggctgatgacgcctgttttcag

SEQ ID NO: 2063 - DNA, 67 bp, Acinetobacter baumannii ACICU
  misc_feature (1)..(67): CP000863.1/439864-439930 Acinetobacter baumannii ACICU, complete genome
ctaaaacagggagatggcattcctcccttgaaaaaccgccgtattggctaatgatgcctacgttacc

SEQ ID NO: 2064 - DNA, 64 bp, Stenotrophomonas maltophilia K279a
  misc_feature (1)..(64): AM743169.1/1735698-1735635 Stenotrophomonas maltophilia K279a complete genome, strain K279a
gaccgcgatggggatggggctcccccgataaccgcctgagaaggctgatggctcctgccaggac

SEQ ID NO: 2065 - DNA, 78 bp, Human gut metagenome; identical to SEQ ID NO: 1060
  misc_feature (1)..(78): BAAZ01017612.1/714-637 Human gut metagenome DNA, contig sequence: F2-X_017612

SEQ ID NO: 2066 - DNA, 60 bp, Bacillus weihenstephanensis KBAB4
  misc_feature (1)..(60): CP000903.1/4869306-4869365 Bacillus weihenstephanensis KBAB4, complete genome
ataatcataggtgatggagttcgccataaccgctgcttagctaatgactcctaccagtat

SEQ ID NO: 2067 - DNA, 67 bp, Burkholderia ambifaria IOP40-10
  misc_feature (1)..(67): ABLC01000046.1/24103-24037 Burkholderia ambifaria IOP40-10 ctg00616, whole genome shotgun sequence
gtcacgcgtggagatggcattcctcctttaaccgccgattcgctcggctgatgatgcctacgtgccc

SEQ ID NO: 2068 - DNA, 67 bp, Burkholderia mallei NCTC 10229; identical to SEQ ID NO: 1339
  misc_feature (1)..(67): CP000545.1/1653068-1653134 Burkholderia mallei NCTC 10229 chromosome II, complete sequence

SEQ ID NO: 2069 - DNA, 64 bp, Yersinia pestis KIM; identical to SEQ ID NO: 1496
  misc_feature (1)..(64): AE009952.1/1314365-1314302 Yersinia pestis KIM, complete genome

SEQ ID NO: 2070 - DNA, 73 bp, Lactococcus lactis subsp. cremoris MG1363
  misc_feature (1)..(73): AM406671.1/272338-272410 Lactococcus lactis subsp. cremoris MG1363, complete genome
ataatagatgggtatggtgcacacccgaaaccgtttcaagaaataacttgaatctaatggcgcctacaaagca

SEQ ID NO: 2071 - DNA, 68 bp, Photobacterium sp. SKA34 1099521381155
  misc_feature (1)..(68): AAOU01000011.1/78540-78473 Photobacterium sp. SKA34 1099521381155, whole genome shotgun sequence
attatggcgggagatgatgttcctccttaaaccgcctttcaatcaaggataatgacgtctaacaacat

SEQ ID NO: 2072 - DNA, 88 bp, Environmental sequence
  misc_feature (1)..(88): AAFX01080011.1/664-577 Environmental sequence 2662324_fasta.screen.Contig7507, whole genome shotgun sequence
tttgggcgcggtgatggagttcaccatctactacaaatatggaaaaccgtccaacttctttagccggactaataactcctacctataa

SEQ ID NO: 2073 - DNA, 64 bp, Acidithiobacillus ferrooxidans ATCC 53993; identical to SEQ ID NO: 421
  misc_feature (1)..(64): CP001132.1/2508708-2508771 Acidithiobacillus ferrooxidans ATCC 53993, complete genome

SEQ ID NO: 2074 - DNA, 67 bp, Ralstonia solanacearum strain IPO1609
  misc_feature (1)..(67): CU914166.1/1142118-1142184 Ralstonia solanacearum strain IPO1609 Genome Draft
ccggcttgcggagatggcatacctcccttaaccgccgatcacctcggctgatgatgcctacaagttc

SEQ ID NO: 2075 - DNA, 60 bp, Bacillus thuringiensis serovar sotto str. T04001; identical to SEQ ID NO: 2019
  misc_feature (1)..(60): ACNB01000166.1/6496-6555 Bacillus thuringiensis serovar sotto str. T04001 contig00032, whole genome shotgun sequence

SEQ ID NO: 2076 - DNA, 60 bp, Bacillus cereus B4264; identical to SEQ ID NO: 1182
  misc_feature (1)..(60): CP001176.1/5025071-5025130 Bacillus cereus B4264, complete genome

SEQ ID NO: 2077 - DNA, 73 bp, Mycobacterium abscessus; identical to SEQ ID NO: 1088
  misc_feature (1)..(73): CU458896.1/2498027-2498099 Mycobacterium abscessus chromosome, complete sequence

SEQ ID NO: 2078 - DNA, 67 bp, Human gut metagenome; identical to SEQ ID NO: 1187
  misc_feature (1)..(67): BABC01003766.1/468-402 Human gut metagenome DNA, contig sequence: In-B_003766

SEQ ID NO: 2079 - DNA, 60 bp, Bacillus cereus AH820; identical to SEQ ID NO: 1182
  misc_feature (1)..(60): CP001283.1/4890016-4890075 Bacillus cereus AH820, complete genome

SEQ ID NO: 2080 - DNA, 73 bp, Environmental sequence s8_174661
  misc_feature (1)..(73): AAQL01009062.1/467-395 Environmental sequence s8_174661, whole genome shotgun sequence
aggcagaaagggaatgaagttctcccccgatttttatcgaaaccgccaatgagctgatgacttctgtgcaatg

SEQ ID NO: 2081 - DNA, 70 bp, Bifidobacterium longum subsp. infantis CCUG 52486
  misc_feature (1)..(70): ABQQ01000001.1/79958-80027 Bifidobacterium longum subsp. infantis CCUG 52486 cont2.1, whole genome shotgun sequence
taaggaaccggcgatggaacccgcctgaactcgtttcgaaccgcacactgctgatagttcctatacacga

SEQ ID NO: 2082 - DNA, 72 bp, Burkholderia phytofirmans PsJN
  misc_feature (1)..(72): CP001052.1/4147651-4147580 Burkholderia phytofirmans PsJN chromosome 1, complete sequence
gaagctttcggagatggcattcctcccgtaaccgccctgcattcccgcagagctgatgatgcctacgagttc

SEQ ID NO: 2083 - DNA, 72 bp, Providencia stuartii ATCC 25827
  misc_feature (1)..(72): ABJD02000101.1/724041-724112 Providencia stuartii ATCC 25827 P_stuartii-2.0.1_Cont1786, whole genome shotgun sequence
ctaacaaaaggagatggcattcctcctgtttaaaaaccgtccaaataaagggctgatgatgcctgcgttcac

SEQ ID NO: 2084 - DNA, 68 bp, Providencia rustigianii DSM 4541
  misc_feature (1)..(68): ABXV02000011.1/470942-470875 Providencia rustigianii DSM 4541 P_rustigianii-1.0.1_Cont0.7, whole genome shotgun sequence
atttatttgggagatggcattcctcctacccaaaccgtccatattggactgatgatgcctacgtaaac

SEQ ID NO: 2085 - DNA, 76 bp, Dorea longicatena DSM 13814; identical to SEQ ID NO: 807
  misc_feature (1)..(76): AAXB02000001.1/235634-235709 Dorea longicatena DSM 13814 D_longicatena-MSIQ_Cont368, whole genome shotgun sequence

SEQ ID NO: 2086 - DNA, 62 bp, Thermoplasmatales archaeon Gpl; identical to SEQ ID NO: 419
  misc_feature (1)..(62): AADL01001839.1/2172-2233 Thermoplasmatales archaeon Gpl AMC_Cont1839, whole genome shotgun sequence

SEQ ID NO: 2087 - DNA, 76 bp, Carnobacterium sp. AT7 1101238000988
  misc_feature (1)..(76): ABHH01000009.1/50257-50182 Carnobacterium sp. AT7 1101238000988, whole genome shotgun sequence
taccattttgggaatgaatgtctcccttagcatactgcttaaaccgcttattaaagctgatgacttctgcgcatag

SEQ ID NO: 2088 - DNA, 62 bp, Aciduliprofundum boonei T469; identical to SEQ ID NO: 241
  misc_feature (1)..(62): ABSD01000051.1/73291-73230 Aciduliprofundum boonei T469 ctg_1104670154630, whole genome shotgun sequence

SEQ ID NO: 2089 - DNA, 72 bp, Leptospirillum sp. Group III; identical to SEQ ID NO: 1648
  misc_feature (1)..(72): AADL01000991.1/122-193 Leptospirillum sp. Group III AMC_Cont991, whole genome shotgun sequence

SEQ ID NO: 2090 - DNA, 73 bp, Human gut metagenome
  misc_feature (1)..(73): BABG01014606.1/762-690 Human gut metagenome DNA, contig sequence: In-R_014606
cgaatgagagggaatgaagttctccctagggaaaccagaactgctgaatatagctgatgacttctacgattat

SEQ ID NO: 2091 - DNA, 67 bp, Burkholderia oklahomensis EO147; identical to SEQ ID NO: 1339
  misc_feature (1)..(67): ABBF01000636.1/6946-6880 Burkholderia oklahomensis EO147 PMP6xxBPSxxE0147-636, whole genome shotgun sequence

SEQ ID NO: 2092 - DNA, 69 bp, Bacteroides plebeius DSM 17135; identical to SEQ ID NO: 1192
  misc_feature (1)..(69): ABQC02000019.1/404312-404380 Bacteroides plebeius DSM 17135 B_plebeius-2.0.1_Cont2578, whole genome shotgun sequence

SEQ ID NO: 2093 - DNA, 62 bp, Aciduliprofundum boonei T469; identical to SEQ ID NO: 241
  misc_feature (1)..(62): ABSD01000048.1/33401-33462 Aciduliprofundum boonei T469 ctg_1104670154627, whole genome shotgun sequence

SEQ ID NO: 2094 - DNA, 60 bp, Bacillus anthracis str. Ames; identical to SEQ ID NO: 1182
  misc_feature (1)..(60): AE016879.1/4823733-4823792 Bacillus anthracis str. Ames, complete genome

SEQ ID NO: 2095 - DNA, 100 bp, Human gut metagenome
  misc_feature (1)..(100): BABB01015950.1/548-449 Human gut metagenome DNA, contig sequence: In-A_015950
aatattactgggaatgaggttctcccaggaacgagatagaaatagctaaatctttcgttcataaccgcttgattataaagctgatgacttctgcaaagcg

SEQ ID NO: 2096 - DNA, 73 bp, Clostridium bolteae ATCC BAA-613; identical to SEQ ID NO: 1346
  misc_feature (1)..(73): ABCC02000039.1/237860-237932 Clostridium bolteae ATCC BAA-613 C_bolteae-3.0.1_Cont299, whole genome shotgun sequence

SEQ ID NO: 2097 - DNA, 67 bp, Burkholderia pseudomallei S13; identical to SEQ ID NO: 1339
  misc_feature (1)..(67): AAHW02000001.1/301150-301084 Burkholderia pseudomallei S13 ctg_1100107453550, whole genome shotgun sequence

SEQ ID NO: 2098 - DNA, 55 bp, Lactobacillus rhamnosus LMS2-1; identical to SEQ ID NO: 1065
  misc_feature (1)..(55): ACIZ01000090.1/22576-22630 Lactobacillus rhamnosus LMS2-1 contig00098, whole genome shotgun sequence

SEQ ID NO: 2099 - DNA, 67 bp, Burkholderia mallei NCTC 10247; identical to SEQ ID NO: 1339
  misc_feature (1)..(67): CP000547.1/225172-225238 Burkholderia mallei NCTC 10247 chromosome II, complete sequence

SEQ ID NO: 2100 - DNA, 71 bp, Human gut metagenome DNA
  misc_feature (1)..(71): BABE01001448.1/1961-1891 Human gut metagenome DNA, contig sequence: In-E_001448
gtccgtgacggcgatggatcccgcctggccgatgccgaactgccgatctggctgatggttcctgccccgtc

SEQ ID NO: 2101 - DNA, 71 bp, Methanobrevibacter smithii DSM 2375; identical to SEQ ID NO: 368
  misc_feature (1)..(71): ABYW01000007.1/311285-311355 Methanobrevibacter smithii DSM 2375 M_smithiDSM2375-1.0_Cont0.8, whole genome shotgun sequence

SEQ ID NO: 2102 - DNA, 60 bp, Bacillus cereus AH187; identical to SEQ ID NO: 1182
  misc_feature (1)..(60): CP001177.1/4829881-4829940 Bacillus cereus AH187, complete genome

SEQ ID NO: 2103 - DNA, 61 bp, Lactobacillus gasseri ATCC 33323
  misc_feature (1)..(61): CP000413.1/283109-283169 Lactobacillus gasseri ATCC 33323, complete genome
aattgaataggcgatgacggtcgccattaaacgagcaaaatctaatgacgtctactattta

SEQ ID NO: 2104 - DNA, 60 bp, Bacillus thuringiensis serovar konkukian str. 97-27; identical to SEQ ID NO: 1182
  misc_feature (1)..(60): AE017355.1/4836662-4836721 Bacillus thuringiensis serovar konkukian str. 97-27, complete genome

SEQ ID NO: 2105 - DNA, 59 bp, Aciduliprofundum boonei T469; identical to SEQ ID NO: 1789
  misc_feature (1)..(59): ABSD01000050.1/82708-82766 Aciduliprofundum boonei T469 ctg_1104670154629, whole genome shotgun sequence

SEQ ID NO: 2106 - DNA, 63 bp, Lactobacillus gasseri ATCC 33323
  misc_feature (1)..(63): CP000413.1/1279279-1279217 Lactobacillus gasseri ATCC 33323, complete genome
attataataggtgatggcgttcaccaatttaaccgattaagatctgacgacgcctactttctt

SEQ ID NO: 2107 - DNA, 61 bp, Rhodopseudomonas palustris HaA2
  misc_feature (1)..(61): CP000250.1/3360939-3360999 Rhodopseudomonas palustris HaA2, complete genome
aacggcgatggggatggagtcccccgacaaccgccgcgaggctgatgactcctaccgggcg

SEQ ID NO: 2108 - DNA, 105 bp, Pectobacterium carotovorum subsp. carotovorum WPP14
  misc_feature (1)..(105): ABVY01000154.1/6708-6604 Pectobacterium carotovorum subsp. carotovorum WPP14 064_059_Sequence00223, whole genome shotgun sequence
tactaaagcggagatgacattcctccctaccctcgcgcagccaaaacgctgacagccttaaaaacagggtacaaccgccactcggctaatgatgtctacgtccac

SEQ ID NO: 2109 - DNA, 74 bp, Clostridium sp. SS2/1; identical to SEQ ID NO: 1389
  misc_feature (1)..(74): ABGC03000023.1/52156-52229 Clostridium sp. SS2/1 Clostridium_sp_SS21-1.0.1_Cont675, whole genome shotgun sequence

SEQ ID NO: 2110 - DNA, 68 bp, Enterococcus faecium DO
  misc_feature (1)..(68): AAAK03000106.1/3475-3542 Enterococcus faecium DO ctg519, whole genome shotgun sequence
aagtgaataggtgtatggtgttcgcctttaaatgctaacgaaagatagctaatgacgcctactaaagt

SEQ ID NO: 2111 - DNA, 73 bp, Human gut metagenome; identical to SEQ ID NO: 1621
  misc_feature (1)..(73): BAAV01013884.1/268-196 Human gut metagenome DNA, contig sequence: F1-T_013884

SEQ ID NO: 2112 - DNA, 62 bp, Human gut metagenome
  misc_feature (1)..(62): BAAW01000138.1/2195-2134 Human gut metagenome DNA, contig sequence: F1-U_000138
agcctcacaggggatggcattcccccttgaaccgccatgtggctaatgatgcctgcttttta

SEQ ID NO: 2113 - DNA, 62 bp, Pseudomonas syringae pv. maculicola plasmid pFKN
  misc_feature (1)..(62): AF359557.1/22906-22967 Pseudomonas syringae pv. maculicola plasmid pFKN, complete sequence
atctgcacaggagatggcattcctccttgaaaccgcctcgtgctgatgatgcctacgtaaac

SEQ ID NO: 2114 - DNA, 65 bp, Environmental sequence XZS73310.b1
  misc_feature (1)..(65): AAFX01046182.1/76-12 Environmental sequence XZS73310.b1, whole genome shotgun sequence
aaccccaagggaaatggtgtcttccctgcacaaaccgcttgaaagctgatgacgccttcaaatcg

SEQ ID NO: 2115 - DNA, 67 bp, Burkholderia pseudomallei 1710b; identical to SEQ ID NO: 1339
  misc_feature (1)..(67): CP000125.1/1222860-1222794 Burkholderia pseudomallei 1710b chromosome II, complete sequence

SEQ ID NO: 2116 - DNA, 79 bp, Bifidobacterium angulatum DSM 20098; identical to SEQ ID NO: 309
  misc_feature (1)..(79): ABYS02000004.1/646163-646241 Bifidobacterium angulatum DSM 20098 B_angulatum-2.0.1_Cont0.2, whole genome shotgun sequence

SEQ ID NO: 2117 - DNA, 70 bp, Human gut metagenome
  misc_feature (1)..(70): BABE01000053.1/15068-15137 Human gut metagenome DNA, contig sequence: In-E_000053
tggagaaccggcgatgggacccgcctgaacttgtttcgaaccgcacactgctgatagttcctacacacga

SEQ ID NO: 2118 - DNA, 75 bp, Mycobacterium ulcerans Agy99; identical to SEQ ID NO: 476
  misc_feature (1)..(75): CP000325.1/3045327-3045401 Mycobacterium ulcerans Agy99, complete genome

SEQ ID NO: 2119 - DNA, 67 bp, Ralstonia solanacearum strain MolK2; identical to SEQ ID NO: 2074
  misc_feature (1)..(67): CU695240.1/565243-565309 Ralstonia solanacearum strain MolK2 Genome Draft

SEQ ID NO: 2120 - DNA, 74 bp, Environmental sequence s8_165414; identical to SEQ ID NO: 854
  misc_feature (1)..(74): AAQL01004413.1/1469-1396 Environmental sequence s8_165414, whole genome shotgun sequence

SEQ ID NO: 2121 - DNA, 71 bp, Environmental sequence s8_178954.2
  misc_feature (1)..(71): AAQL01000312.1/1879-1949 Environmental sequence s8_178954.2, whole genome shotgun sequence
taataacttggtgatggggttcaccagaaacttattttcaaaccgcaattgctgataactcctaggttata

SEQ ID NO: 2122 - DNA, 69 bp, Xanthomonas campestris pv. Vesicatoria
  misc_feature (1)..(69): AM039952.1/2350991-2351059 Xanthomonas campestris pv. vesicatoria complete genome
ggccgcacaggagatggcattcctcctcgaaccgcacgcaccctgcgcgctgatgatgcctgcccaccc

SEQ ID NO: 2123 - DNA, 62 bp, Chloroflexus sp. Y-400-fl; identical to SEQ ID NO: 393
  misc_feature (1)..(62): CP001364.1/429603-429664 Chloroflexus sp. Y-400-fl, complete genome

SEQ ID NO: 2124 - DNA, 73 bp, Human gut metagenome
  misc_feature (1)..(73): BAAY01017851.1/254-182 Human gut metagenome DNA, contig sequence: F2-W_017851
tagctggcagggaatgaagttctccccaggcagtgcctaaaccgctattacagctgatgacttctgttgttta

SEQ ID NO: 2125 - DNA, 60 bp, Bacillus anthracis str. A0248; identical to SEQ ID NO: 1182
  misc_feature (1)..(60): CP001598.1/4823759-4823818 Bacillus anthracis str. A0248, complete genome

SEQ ID NO: 2126 - DNA, 70 bp, Human gut metagenome; identical to SEQ ID NO: 2117
  misc_feature (1)..(70): BABF01001201.1/3795-3726 Human gut metagenome DNA, contig sequence: In-M_001201

SEQ ID NO: 2127 - DNA, 64 bp, Dictyoglomus thermophilum H-6-12
  misc_feature (1)..(64): CP001146.1/51886-51949 Dictyoglomus thermophilum H-6-12, complete genome
atcacaagtggcgatggagtccgccatataattgccgataaaggctgatgactcctacttatgt

SEQ ID NO: 2128 - DNA, 60 bp, Bacillus thuringiensis str. Al Hakam; identical to SEQ ID NO: 1182
  misc_feature (1)..(60): CP000485.1/4850198-4850257 Bacillus thuringiensis str. Al Hakam, complete genome

SEQ ID NO: 2129 - DNA, 65 bp, Lactobacillus casei BL23; identical to SEQ ID NO: 453
  misc_feature (1)..(65): FM177140.1/2571522-2571586 Lactobacillus casei BL23 complete genome, strain BL23

SEQ ID NO: 2130 - DNA, 71 bp, Leptospirillum rubarum; identical to SEQ ID NO: 800
  misc_feature (1)..(71): AAWO01000020.1/7863-7793 Leptospirillum rubarum LeptoII_Scaffold_8049_Cont20, whole genome shotgun sequence

SEQ ID NO: 2131 - DNA, 84 bp, Photobacterium profundum SS9; identical to SEQ ID NO: 1556
  misc_feature (1)..(84): CR378667.1/326415-326332 Photobacterium profundum SS9; segment 5/12

SEQ ID NO: 2132 - DNA, 63 bp, Pseudomonas aeruginosa LESB58; identical to SEQ ID NO: 1675
  misc_feature (1)..(63): FM209186.1/5248344-5248282 Pseudomonas aeruginosa LESB58 complete genome sequence

SEQ ID NO: 2133 - DNA, 60 bp, Bacillus cereus 03BB102; identical to SEQ ID NO: 1182
  misc_feature (1)..(80): CP001407.1/4853207-4853266 Bacillus cereus 03BB102, complete genome

SEQ ID NO: 2134 - DNA, 67 bp, Vibrio fischeri MJ11
  misc_feature (1)..(67): CP001139.1/34842-34908 Vibrio fischeri MJ11 chromosome I, complete sequence
ccaaatacgggtgatggatttccacctttaaccgctctattttagagataatgattcctactatagc

SEQ ID NO: 2135 - DNA, 68 bp, Xanthomonas axonopodis pv. citri str. 306
  misc_feature (1)..(68): AE008923.1/2352963-2353030 Xanthomonas axonopodis pv. citri str. 306, complete genome
ggccgcacaggagatggcattcctcctcgaaccgcacgcacccgcgcgctgatgatgcctgcccaccc

SEQ ID NO: 2136 - DNA, 70 bp, Human gut metagenome; identical to SEQ ID NO: 950
  misc_feature (1)..(70): BABC01000066.1/7792-7723 Human gut metagenome DNA, contig sequence: In-B_000066

SEQ ID NO: 2137 - DNA, 82 bp, Anabaena variabilis ATCC 29413
  misc_feature (1)..(82): CP000117.1/118149-118230 Anabaena variabilis ATCC 29413, complete genome
gttactaatggcgatggagttcgcccaaaccgctattctagtcaaaaaataaatctagaaggctgatgactcctactactct

SEQ ID NO: 2138 - DNA, 76 bp, Thermococcus barophilus MP
  misc_feature (1)..(76): CP002372.1/388527-388452 Thermococcus barophilus MP, complete genome
gtttagtcgggcgatggcgtccgcccgggcttcgagcccgaaccgcccgttaagggctgatgacgcctgttctacc

SEQ ID NO: 2139 - DNA, 101 bp, Synechococcus sp. JA-3-3Ab
  misc_feature (1)..(101): CP000239.1/520035-519935 Synechococcus sp. JA-3-3Ab, complete genome
ccggcaacgggcgatggggttcgccgcaaccgcctcaggcagatcctagggataaagtttctctaagacttagagctggggctgatgactcctactcttct

SEQ ID NO: 2140 - DNA, 66 bp, Lactobacillus plantarum subsp. plantarum ST-III; identical to SEQ ID NO: 316
  misc_feature (1)..(66): CP002222.1/1678154-1678089 Lactobacillus plantarum subsp. plantarum ST-III, complete genome

SEQ ID NO: 2141 - DNA, 83 bp, Photobacterium profundum 3TCK
  misc_feature (1)..(83): AAPH01000002.1/303167-303249 Photobacterium profundum 3TCK 1099451005285, whole genome shotgun sequence
attatgacgggagatgatgatcctcctttaactgccttactgaagtttacccttcttataaggatgatgacgtctaacaacat

SEQ ID NO: 2142 - DNA, 84 bp, Vibrionales bacterium SWAT-3 1101732140416
  misc_feature (1)..(84): AAZW01000073.1/10424-10341 Vibrionales bacterium SWAT-3 1101732140416, whole genome shotgun sequence
tagccatcaggtgatggggttccacctaagcttttgcttcaaccgcccgttcttttgaaccgtgctaatggctcctacagaatc

SEQ ID NO: 2143 - DNA, 60 bp, Bacillus cereus Q1
  misc_feature (1)..(60): CP000227.1/4763720-4763779 Bacillus cereus Q1, complete genome
ataattataggcgatggagttcgccataaacgctgcttagctaatgactcctaccagtat

SEQ ID NO: 2144 - DNA, 75 bp, Leptospirillum sp. Group II '5-way CG'
  misc_feature (1)..(75): AADL01002490.1/18401-18475 Leptospirillum sp. Group II '5-way CG' ctg10933, whole genome shotgun sequence
atgacgaggggtgatggagtccacctgaacggccctttctttcataaggaaagggatgatgactcctgtgagaga

SEQ ID NO: 2145 - DNA, 55 bp, Lactobacillus paracasei subsp. paracasei 8700:2; identical to SEQ ID NO: 1761
  misc_feature (1)..(55): ABQV01000049.1/12339-12285 Lactobacillus paracasei subsp. paracasei 8700:2 cont2.49, whole genome shotgun sequence

SEQ ID NO: 2146 - DNA, 76 bp, Vibrio alginolyticus 12G01
  misc_feature (1)..(76): AAPS01000002.1/29498-29423 Vibrio alginolyticus 12G01 1100007009696, whole genome shotgun sequence
aatgggttcggtgatggggtaccaccggaatcgaaagattcgaaccgctgttaaagctaatgactcctacagaaac

SEQ ID NO: 2147 - DNA, 67 bp, Burkholderia mallei PRL-20; identical to SEQ ID NO: 1339
  misc_feature (1)..(67): AAZP01000053.1/29998-29932 Burkholderia mallei PRL-20 gcontig_1105338602060, whole genome shotgun sequence

SEQ ID NO: 2148 - DNA, 74 bp, Human gut metagenome; identical to SEQ ID NO: 353
  misc_feature (1)..(74): BABG01014343.1/547-474 Human gut metagenome DNA, contig sequence: In-R_014343

SEQ ID NO: 2149 - DNA, 70 bp, Human gut metagenome; identical to SEQ ID NO: 2117
  misc_feature (1)..(70): BABB01014491.1/724-793 Human gut metagenome DNA, contig sequence: In-A_014491

SEQ ID NO: 2150 - DNA, 67 bp, Burkholderia ambifaria IOP40-10
  misc_feature (1)..(67): ABLC01000083.1/20871-20937 Burkholderia ambifaria IOP40-10 ctg00076, whole genome shotgun sequence
gttggccgtggagatggcattcctcccttaactgccgattcgttcggctgatgatgcctacacaccc

SEQ ID NO: 2151 - DNA, 76 bp, Xanthomonas campestris pv. campestris; identical to SEQ ID NO: 1071
  misc_feature (1)..(76): AM920689.1/2646740-2646665 Xanthomonas campestris pv. campestris complete genome, strain B100

SEQ ID NO: 2152 - DNA, 67 bp, Human gut metagenome; identical to SEQ ID NO: 1187
  misc_feature (1)..(67): BABF01015109.1/43-109 Human gut metagenome DNA, contig sequence: In-M_015109

SEQ ID NO: 2153 - DNA, 81 bp, Pyrococcus horikoshii OT3
  misc_feature (1)..(81): BA000001.2/1278365-1278285 Pyrococcus horikoshii OT3 DNA, complete genome
ggttccttgggcgatggcgcccgcccggggcttcgagcccgaaccgcctcccgttgggaggctgatggcgcctattctgta

SEQ ID NO: 2154 - DNA, 60 bp, Clostridium botulinum E3 str. Alaska E43
  misc_feature (1)..(60): CP001078.1/1342444-1342385 Clostridium botulinum E3 str. Alaska E43, complete genome
tatatattaggtgatggagttcgcctttaaacgcgtaatgctaatgactcctacaaaaaa

SEQ ID NO: 2155 - DNA, 63 bp, Pseudomonas aeruginosa UCBPP-PA14; identical to SEQ ID NO: 1675
  misc_feature (1)..(63): CP000438.1/5078189-5078127 Pseudomonas aeruginosa UCBPP-PA14, complete genome

SEQ ID NO: 2156 - DNA, 62 bp, Desulfovibrio piger ATCC 29098; identical to SEQ ID NO: 539
  misc_feature (1)..(62): ABXU01000089.1/23581-23642 Desulfovibrio piger ATCC 29098 D_piger_ATCC29098-1.0_Cont10.5, whole genome shotgun sequence

SEQ ID NO: 2157 - DNA, 60 bp, Clostridium kluyveri NBRC 12016; identical to SEQ ID NO: 940
  misc_feature (1)..(60): AP009049.1/304406-304465 Clostridium kluyveri NBRC 12016 DNA, complete genome

SEQ ID NO: 2158 - DNA, 63 bp, Thermus aquaticus Y51MC23
  misc_feature (1)..(63): ABVK02000003.1/30981-31043 Thermus aquaticus Y51MC23 ctg73, whole genome shotgun sequence
tgcccttagggcgatggagtccgccttaaccgcccgcttcgggctgatgactcctaccgggtt

SEQ ID NO: 2159 - DNA, 69 bp, Environmental sequence
  misc_feature (1)..(69): AAFX01005291.1/667-735 Environmental sequence 2662324_fasta.screen.Contig38989, whole genome shotgun sequence
acgtcgcgtggtggtggagtccacctgaaccgccgctctgactggacggccaatgactcctacgcatag

SEQ ID NO: 2160 - DNA, 77 bp, Eubacterium biforme DSM 3989; identical to SEQ ID NO: 1686
  misc_feature (1)..(77): ABYT01000096.1/44476-44400 Eubacterium biforme DSM 3989 E_biforme-1.0.1_Cont8.4, whole genome shotgun sequence

SEQ ID NO: 2161 - DNA, 64 bp, Thermotoga petrophila RKU-1
  misc_feature (1)..(64): CP000702.1/1794817-1794880 Thermotoga petrophila RKU-1, complete genome
aacccaacgggcgatgaggcccgcccaaactgccctgaagagggctgatggcctctactggctt

SEQ ID NO: 2162 - DNA, 75 bp, Lactococcus lactis subsp. cremoris MG1363; identical to SEQ ID NO: 307
  misc_feature (1)..(75): AM406671.1/1450312-1450238 Lactococcus lactis subsp. cremoris MG1363, complete genome

SEQ ID NO: 2163 - DNA, 64 bp, Yersinia pestis Pestoides F; identical to SEQ ID NO: 1496
  misc_feature (1)..(64): CP000668.1/3010272-3010335 Yersinia pestis Pestoides F, complete genome

SEQ ID NO: 2164 - DNA, 84 bp, Vibrio splendidus 12B01
  misc_feature (1)..(84): AAMR01000022.1/13784-13701 Vibrio splendidus 12B01 1099451319040, whole genome shotgun sequence
tagccatcaggtgatggggttccacctaagcttttgcttcaaccgcccgttctttcgaacagtgctaatgactcctacagaatc

SEQ ID NO: 2165 - DNA, 67 bp, Acinetobacter baumannii str. AYE; identical to SEQ ID NO: 1374
  misc_feature (1)..(67): CU459141.1/3434387-3434321 Acinetobacter baumannii str. AYE, complete genome

SEQ ID NO: 2166 - DNA, 59 bp, Thermoanaerobacter sp. X514
  misc_feature (1)..(59): CP000923.1/40525-40583 Thermoanaerobacter sp. X514, complete genome
ataccataaggcgatggagctcgccataaatgcggaacgctgatggctcctattaggag

SEQ ID NO: 2167 - DNA, 73 bp, Human gut metagenome
  misc_feature (1)..(73): BAAV01021889.1/203-131 Human gut metagenome DNA, contig sequence: F1-T_021889
gaaacaaatgggaatgaatgtctccccgggatcatcccgaaccgcttattaagctgatgacttctgtgataac

SEQ ID NO: 2168 - DNA, 80 bp, Ruminococcus obeum ATCC 29174
  misc_feature (1)..(80): AAVO02000004.1/13914-13993 Ruminococcus obeum ATCC 29174 R_obeum-MSIQ_Cont159, whole genome shotgun sequence
aaatataaagggaatgaggttctccctaagtaataaaattacttaaaccgcttatgaaagctgatgacttctgcgagtaa

SEQ ID NO: 2169 - DNA, 76 bp, Thermococcus sp. AM4
  misc_feature (1)..(76): CP002952.1/944770-944695 Thermococcus sp. AM4, complete genome
agggggacgggcgatggcgtccgcccggggcttcgagcccgaaccgcccgctcgggctgatgacgcctgttctacc

SEQ ID NO: 2170 - DNA, 60 bp, Bacillus cereus G9842; identical to SEQ ID NO: 2019
  misc_feature (1)..(60): CP001186.1/4973458-4973517 Bacillus cereus G9842, complete genome

SEQ ID NO: 2171 - DNA, 64 bp, Yersinia pseudotuberculosis YPIII; identical to SEQ ID NO: 1496
  misc_feature (1)..(64): CP000950.1/3331346-3331409 Yersinia pseudotuberculosis YPIII, complete genome

SEQ ID NO: 2172 - DNA, 78 bp, Human gut metagenome; identical to SEQ ID NO: 1060
  misc_feature (1)..(78): BAAY01001852.1/271-348 Human gut metagenome DNA, contig sequence: F2-W_001852

SEQ ID NO: 2173 - DNA, 63 bp, Pseudomonas aeruginosa PA7
  misc_feature (1)..(63): CP000744.1/5109630-5109568 Pseudomonas aeruginosa PA7, complete genome
tagccggcaggagatggcattcctccttcaaccgcccctggggctgatgatgcctacgcatga

SEQ ID NO: 2174 - DNA, 62 bp, Burkholderia phytofirmans PsJN
  misc_feature (1)..(62): CP001052.1/1800329-1800268 Burkholderia phytofirmans PsJN chromosome 1, complete sequence
ttgcgcgctggagatggcattctcccttaaccgccctcgtggctgatgatgcctgcttcgtc

SEQ ID NO: 2175 - DNA, 59 bp, Aciduliprofundum boonei T469; identical to SEQ ID NO: 1789
  misc_feature (1)..(59): ABSD01000048.1/169379-169321 Aciduliprofundum boonei T469 ctg_1104670154627, whole genome shotgun sequence

SEQ ID NO: 2176 - DNA, 63 bp, Yersinia intermedia ATCC 29909
  misc_feature (1)..(63): AALF02000002.1/247760-247698 Yersinia intermedia ATCC 29909 contig01174, whole genome shotgun sequence
gcaagatctggagatgacattcctccataaccgcccttcaaggctgatgatgtctacgtaacc

SEQ ID NO: 2177 - DNA, 67 bp, Burkholderia mallei SAVP1; identical to SEQ ID NO: 1339
  misc_feature (1)..(67): CP000525.1/1388196-1388262 Burkholderia mallei SAVP1 chromosome II, complete sequence

SEQ ID NO: 2178 - DNA, 106 bp, Burkholderia graminis C4D1M
  misc_feature (1)..(106): ABLD01000041.1/16968-17073 Burkholderia graminis C4D1M ctg26, whole genome shotgun sequence
ttgcgtgctggagatggcattctccaatgggtgtccggcgtgcgcttcaacacacgcgctcgcgcgaacccattaaccgcctcgtgctgatgatgcctgcttcccc

SEQ ID NO: 2179 - DNA, 79 bp, Human gut metagenome
  misc_feature (1)..(79): BAAZ01021286.1/777-699 Human gut metagenome DNA, contig sequence: F2-X_021286
agaataaacgggaatgaagttctcccgaagtaaccagattacttgaaccgctttaaaagctgatgacttctgcgacgaa

SEQ ID NO: 2180 - DNA, 60 bp, Bacillus anthracis str. Sterne; identical to SEQ ID NO: 1182
  misc_feature (1)..(60): AE017225.1/4825068-4825127 Bacillus anthracis str. Sterne, complete genome

SEQ ID NO: 2181 - DNA, 66 bp, Vibrio fischeri MJ11; identical to SEQ ID NO: 1185
  misc_feature (1)..(66): CP001133.1/1365444-1365379 Vibrio fischeri MJ11 chromosome II, complete sequence

SEQ ID NO: 2182 - DNA, 85 bp, Coprococcus eutactus ATCC 27759
  misc_feature (1)..(85): ABEY02000020.1/92291-92375 Coprococcus eutactus ATCC 27759 C_eutactus-2.0.1_Cont273, whole genome shotgun sequence
attataaaagggaatgaggttctcctctggaaaacctgaatgggcaacctaaactgctaatatagctgatgacttctacgattat

SEQ ID NO: 2183 - DNA, 73 bp, Anaerococcus hydrogenalis DSM
  misc_feature (1)..(73): ABXA01000043.1/134014-134086 Anaerococcus hydrogenalis DSM 7454 A_hydrogenalis-1.0_Cont165.1, whole genome shotgun sequence
atattagaagggaatgaagttctcccttagaaaaatctaaaaccgcatttatgctgatgacttctgtaactat

SEQ ID NO: 2184 - DNA, 62 bp, Chloroflexus aggregans DSM 9485
  misc_feature (1)..(62): CP001337.1/1659433-1659494 Chloroflexus aggregans DSM 9485, complete genome
tagctcataggtgataaggctcaccgttgaactgcccgcgggctgatggcctctacagaagt

SEQ ID NO: 2185 - DNA, 63 bp, Pseudomonas aeruginosa C3719; identical to SEQ ID NO: 1675
  misc_feature (1)..(63): AAKV01000114.1/24659-24721 Pseudomonas aeruginosa C3719 cont1.114, whole genome shotgun sequence

SEQ ID NO: 2186 - DNA, 82 bp, Human gut metagenome
  misc_feature (1)..(82): BABF01003476.1/1904-1985 Human gut metagenome DNA, contig sequence: In-M_003476
ctgttacccgggaatgaggtctcccatggtagtgtaatatttaccagaaccgcttatgacagctgatggcttctgcattgtg

SEQ ID NO: 2187 - DNA, 67 bp, Burkholderia pseudomallei 1710a; identical to SEQ ID NO: 1339
  misc_feature (1)..(67): AAHS03000001.1/321518-321584 Burkholderia pseudomallei 1710a gcontig_1105229757784, whole genome shotgun sequence

SEQ ID NO: 2188 - DNA, 69 bp, Providencia alcalifaciens DSM 30120
  misc_feature (1)..(69): ABXW01000051.1/16406-16474 Providencia alcalifaciens DSM 30120 P_alcalifaciens-1.0_Cont137.1, whole genome shotgun sequence
gtcttgttaggagatggcattcctcctagtttaaccgtccttttgtggactgatgatgcctacgtaaac

SEQ ID NO: 2189 - DNA, 60 bp, Carboxydibrachium pacificum DSM 12653; identical to SEQ ID NO: 1274
  misc_feature (1)..(60): ABXP01000064.1/2857-2798 Carboxydibrachium pacificum DSM 12653 ctg_1106511212226, whole genome shotgun sequence

SEQ ID NO: 2190 - DNA, 77 bp, Xanthomonas oryzae pv. oryzae PXO99A; identical to SEQ ID NO: 1137
  misc_feature (1)..(77): CP000967.1/2767544-2767620 Xanthomonas oryzae pv. oryzae PXO99A, complete genome

SEQ ID NO: 2191 - DNA, 55 bp, Lactobacillus casei BL23; identical to SEQ ID NO: 1761
  misc_feature (1)..(55): FM177140.1/2570801-2570747 Lactobacillus casei BL23 complete genome, strain BL23

SEQ ID NO: 2192 - DNA, 105 bp, Pectobacterium carotovorum subsp. brasiliensis PBR1692; identical to SEQ ID NO: 2108
  misc_feature (1)..(105): ABVX01000036.1/35509-35405 Pectobacterium carotovorum subsp. brasiliensis PBR1692 0044_0031_Sequence00019, whole genome shotgun sequence

SEQ ID NO: 2193 - DNA, 74 bp, Human gut metagenome
  misc_feature (1)..(74): BABG01003409.1/431-358 Human gut metagenome DNA, contig sequence: In-R_003409
aaagaaaaagggaatgaagttctccctcgaagagattcgaaaccgcttattaagctgatgacttctgtgtaatg

SEQ ID NO: 2194 - DNA, 70 bp, Bifidobacterium longum DJO10A; identical to SEQ ID NO: 2117
  misc_feature (1)..(70): CP000605.1/969434-969503 Bifidobacterium longum DJO10A, complete genome

SEQ ID NO: 2195 - DNA, 61 bp, Carboxydibrachium pacificum DSM 12653; identical to SEQ ID NO: 986
  misc_feature (1)..(61): ABXP01000064.1/9651-9591 Carboxydibrachium pacificum DSM 12653 ctg_1106511212226, whole genome shotgun sequence

SEQ ID NO: 2196 - DNA, 79 bp, Gluconacetobacter diazotrophicus PAl 5; identical to SEQ ID NO: 528
  misc_feature (1)..(79): CP001189.1/2909225-2909147 Gluconacetobacter diazotrophicus PAl 5, complete genome

SEQ ID NO: 2197 - DNA, 64 bp, Caldicellulosiruptor saccharolyticus; identical to SEQ ID NO: 1073
  misc_feature (1)..(64): L39876.1/4762-4825 Caldicellulosiruptor saccharolyticus alpha-dextrin 6-glucanohydrolase (pulA) and pepX genes, complete cds and pepY gene, partial cds

SEQ ID NO: 2198 - DNA, 67 bp, Acinetobacter sp. ATCC 27244
  misc_feature (1)..(67): ABYN01000048.1/132548-132614 Acinetobacter sp. ATCC 27244 contig00048, whole genome shotgun sequence
tagggcaaaggagatggcattcctcctgtaacaaaccgccattgtggctaatgatgcctacgttact

SEQ ID NO: 2199 - DNA, 67 bp, Burkholderia pseudomallei 14 PMP6xxBPSxx14-1663; identical to SEQ ID NO: 1339
  misc_feature (1)..(67): ABBJ01001663.1/1415-1349 Burkholderia pseudomallei 14 PMP6xxBPSxx14-1663, whole genome shotgun sequence

SEQ ID NO: 2200 - DNA, 65 bp, Leeuwenhoekiella blandensis MED217 1099517004302; identical to SEQ ID NO: 1670
  misc_feature (1)..(65): AANC01000009.1/2226-2162 Leeuwenhoekiella blandensis MED217 1099517004302, whole genome shotgun sequence

SEQ ID NO: 2201 - DNA, 70 bp, Human gut metagenome
  misc_feature (1)..(70): BABE01006493.1/378-447 Human gut metagenome DNA, contig sequence: In-E_006493
taaggaaccggcgatggaacccgcctgaactcgtttcgaaccgcacactgctgatagttcctacacacga

SEQ ID NO: 2202 - DNA, 76 bp, Vibrio harveyi HY01
  misc_feature (1)..(76): AAWP01000027.1/44793-44868 Vibrio harveyi HY01 gcontig_1104549816479, whole genome shotgun sequence
aatgcacacggtgatggggtgccaccagaatcgaaagattcaaaccgcttttacagctgatgactcctacagaaac

SEQ ID NO: 2203 - DNA, 63 bp, Marine metagenome 1096626735748; identical to SEQ ID NO: 1162
  misc_feature (1)..(63): AACY020346117.1/2623-2561 Marine metagenome 1096626735748, whole genome shotgun sequence

SEQ ID NO: 2204 - DNA, 67 bp, Burkholderia thailandensis MSMB43 PMP6xxBPSxx381-878; identical to SEQ ID NO: 1339
  misc_feature (1)..(67): ABBM01000878.1/872-806 Burkholderia thailandensis MSMB43 PMP6xxBPSxx381-878, whole genome shotgun sequence

SEQ ID NO: 2205 - DNA, 74 bp, Environmental sequence s7_178954.3
  misc_feature (1)..(74): AAQK01000307.1/4537-4610 Environmental sequence s7_178954.3, whole genome shotgun sequence
taataacttggtgatggggttcaccagaaacttattttcaaaccgcaaaaattgctgataactcctatgttata

SEQ ID NO: 2206 - DNA, 67 bp, Burkholderia pseudomallei NCTC 13177; identical to SEQ ID NO: 1339
  misc_feature (1)..(67): ABBQ01000905.1/4347-4281 Burkholderia pseudomallei NCTC 13177 strain NCTC13177 PMP6xxBPSxxNCTC13177-905, whole genome shotgun sequence

SEQ ID NO: 2207 - DNA, 69 bp, Environmental sequence XZS55564.b1
  misc_feature (1)..(69): AAFX01053991.1/352-284 Environmental sequence XZS55564.b1, whole genome shotgun sequence
aacgataacggcgatggggttcgccagtcaaaccactcgcggcggcgagttgatgacccctacttcgag

SEQ ID NO: 2208 - DNA, 65 bp, Aliivibrio salmonicida LFI1238
  misc_feature (1)..(65): FM178380.1/1142244-1142180 Aliivibrio salmonicida LFI1238 chromosome 2 complete genome
ggcgtacaaggtgatggggtgccacctacttaaccgccaatttggctgatgactcctacagtaaa

SEQ ID NO: 2209 - DNA, 67 bp, Burkholderia pseudomallei 576; identical to SEQ ID NO: 1339
  misc_feature (1)..(67): ACCE01000005.1/360072-360138 Burkholderia pseudomallei 576 BUC.Contig185, whole genome shotgun sequence

SEQ ID NO: 2210 - DNA, 75 bp, Eubacterium ventriosum ATCC 27560; identical to SEQ ID NO: 1119
  misc_feature (1)..(75): AAVL02000037.1/287218-287292 Eubacterium ventriosum ATCC 27560 E_ventriosum-MSIQ_Cont233, whole genome shotgun sequence

SEQ ID NO: 2211 - DNA, 69 bp, Human gut metagenome; identical to SEQ ID NO: 603
  misc_feature (1)..(69): BABD01000872.1/1124-1056 Human gut metagenome DNA, contig sequence: In-D_000872

SEQ ID NO: 2212 - DNA, 67 bp, Burkholderia pseudomallei Pakistan 9; identical to SEQ ID NO: 1339
  misc_feature (1)..(67): ACKA01000027.1/241427-241361 Burkholderia pseudomallei Pakistan 9 BUH.Contig272, whole genome shotgun sequence

SEQ ID NO: 2213 - DNA, 65 bp, Lactobacillus paracasei subsp. paracasei ATCC 25302; identical to SEQ ID NO: 453
  misc_feature (1)..(65): ACGY01000069.1/12451-12387 Lactobacillus paracasei subsp. paracasei ATCC 25302 contig00110, whole genome shotgun sequence

SEQ ID NO: 2214 - DNA, 81 bp, Pyrococcus abyssi GE5
  misc_feature (1)..(81): AJ248285.1/89834-89914 Pyrococcus abyssi GE5 complete genome; segment 3/6
gttctcttgggcgatggcgcccgcccggggcttcgagcccgaaccgcctcccatggggaggctgatggcgcctattcttga

SEQ ID NO: 2215 - DNA, 67 bp, Burkholderia pseudomallei 112 PMP6xxBPSxx112-1115; identical to SEQ ID NO: 1339
  misc_feature (1)..(67): ABBP01001115.1/6777-6711 Burkholderia pseudomallei 112 PMP6xxBPSxx112-1115, whole genome shotgun sequence

SEQ ID NO: 2216 - DNA, 67 bp, Burkholderia mallei ATCC 23344; identical to SEQ ID NO: 1339
  misc_feature (1)..(67): CP000011.2/224010-224076 Burkholderia mallei ATCC 23344 chromosome 2, complete sequence

SEQ ID NO: 2217 - DNA, 67 bp, Burkholderia mallei JHU; identical to SEQ ID NO: 1339
  misc_feature (1)..(67): AAIR02000026.1/4415-4481 Burkholderia mallei JHU ctg_1099471777536, whole genome shotgun sequence

SEQ ID NO: 2218 - DNA, 76 bp, Clostridiales bacterium 1_7_47_FAA; identical to SEQ ID NO: 570
  misc_feature (1)..(76): ABQR01000024.1/52165-52090 Clostridiales bacterium 1_7_47_FAA cont2.24, whole genome shotgun sequence

SEQ ID NO: 2219 - DNA, 60 bp, Bacillus anthracis str. CDC 684; identical to SEQ ID NO: 1182
  misc_feature (1)..(60): CP001215.1/4826181-4826240 Bacillus anthracis str. CDC 684, complete genome

SEQ ID NO: 2220 - DNA, 69 bp, Environmental sequence XZS67508.x1
  misc_feature (1)..(69): AAFX01041918.1/509-577 Environmental sequence XZS67508.x1, whole genome shotgun sequence
aagtccgaaggcggtggagtccgccacaaccgtcatgcgcctgccgtggccaatgactcctgcggggtt

SEQ ID NO: 2221 - DNA, 67 bp, Burkholderia mallei GB8 horse 4; identical to SEQ ID NO: 1339
  misc_feature (1)..(67): AAHO01000134.1/6134-6200 Burkholderia mallei GB8 horse 4 contig_456, whole genome shotgun sequence

SEQ ID NO: 2222 - DNA, 62 bp, Oligotropha carboxidovorans OM5 strain OM5; identical to SEQ ID NO: 767
  misc_feature (1)..(62): CP001196.1/1408427-1408488 Oligotropha carboxidovorans OM5 strain OM5, complete genome

SEQ ID NO: 2223 - DNA, 70 bp, Enterococcus faecalis HIP11704; identical to SEQ ID NO: 917
  misc_feature (1)..(70): ACAN01000070.1/46719-46650 Enterococcus faecalis HIP11704 cont1.70, whole genome shotgun sequence

SEQ ID NO: 2224 - DNA, 76 bp, Marine metagenome
  misc_feature (1)..(76): AACY023333559.1/192-117 Marine metagenome ctg_1101668140910, whole genome shotgun sequence
aatagtggcgggaatgaagtgctcccttcatatgatatgaaaaccgcaaacacgtgctgatgacttctacgatttt

SEQ ID NO: 2225 - DNA, 63 bp, Human gut metagenome
  misc_feature (1)..(63): BAAV01007000.1/1090-1152 Human gut metagenome DNA, contig sequence: F1-T_007000
ctttgcaccggctatgggattagcctttaaccgcccttcggagctgatgatccctacaatttg

SEQ ID NO: 2226 - DNA, 71 bp, Human gut metagenome
  misc_feature (1)..(71): BAAV01024370.1/684-614 Human gut metagenome DNA, contig sequence: F1-T_024370
tcagnnatcgggaatgatgttctcccctgggattccaaaaccgctgtttcgctgatgacgtctgctttttt

SEQ ID NO: 2227 - DNA, 64 bp, Stenotrophomonas maltophilia R551-3
  misc_feature (1)..(64): CP001111.1/1611287-1611224 Stenotrophomonas maltophilia R551-3, complete genome
ggcgacgatggggatggggctcccccgataaccgcctgagaaggctgatggctcctgccaagac

SEQ ID NO: 2228 - DNA, 61 bp, Leptospirillum sp. Group III; identical to SEQ ID NO: 310
  misc_feature (1)..(61): AADL01000572.1/2844-2904 Leptospirillum sp. Group III AMC_Cont572, whole genome shotgun sequence

SEQ ID NO: 2229 - DNA, 63 bp, Serratia sp. DD3
  misc_feature (1)..(63): AYKS02000112.1/26161-26223 Serratia sp. DD3 SRDD_contig000112, whole genome shotgun sequence
ctgacaaacggagatgacatgcctccataaccgccccattaggctgatggtgtctacgctacc

SEQ ID NO: 2230 - DNA, 64 bp, Streptomyces griseofuscus strain NG1-7
  misc_feature (1)..(64): MTKC01000003.1/5836372-5836309 Streptomyces griseofuscus strain NG1-7 NG1-17_1_1, whole genome shotgun sequence
acggagatgggcgatgaggctcgcccttgagcgcacgttccgtgctgatggcctctgcgagcac

SEQ ID NO: 2231 - DNA, 63 bp, Sphingobacterium sp. CZ-UAM QB.A_0
  misc_feature (1)..(63): MTCM01000001.1/2219788-2219850 Sphingobacterium sp. CZ-UAM QB.A_0, whole genome shotgun sequence
tgaatatatggcaatgatgtctgccttgaactgccctaataagctgatgacgtctactttaag

SEQ ID NO: 2232 - RNA, 71 nt, Artificial sequence
  Synthetic polynucleotide
  misc_feature (5)..(6): n is a, c, g, or u
ucagnnaucgggaaugauguucuccccugggauuccaaaaccgcuguuucgcugaugacgucugcuuuuuu

SEQ ID NO: 2233 - RNA, 71 nt, Artificial sequence
  Synthetic polynucleotide
guccgugacggcgauggaucccgccuggccgaugccgaacugccgaucuggcugaugguuccugccccguc

SEQ ID NO: 2234 - RNA, 63 nt, Artificial sequence
  Synthetic polynucleotide
cuuugcaccggcuaugggauuagccuuuaaccgcccuucggagcugaugaucccuacaauuug

SEQ ID NO: 2235 - RNA, 70 nt, Artificial sequence
  Synthetic polynucleotide
cugggauucggcgaugggacccgccugaacuuguuucgaaccgcacacugcugauaguuccuacacacga

SEQ ID NO: 2236 - RNA, 70 nt, Artificial sequence
  Synthetic polynucleotide
uaaggaaccggcgauggaacccgccugaacucguuucgaaccgcacacugcugauaguuccuacacacga

SEQ ID NO: 2237 - RNA, 70 nt, Artificial sequence
  Synthetic polynucleotide
uggagaaccggcgaugggacccgccugaacuuguuucgaaccgcacacugcugauaguuccuacacacga

SEQ ID NO: 2238 - RNA, 70 nt, Artificial sequence; identical to SEQ ID NO: 2237
  Synthetic polynucleotide

SEQ ID NO: 2239 - RNA, 70 nt, Artificial sequence; identical to SEQ ID NO: 2237
  Synthetic polynucleotide

SEQ ID NO: 2240 - RNA, 73 nt, Artificial sequence
  Synthetic polynucleotide
uagcuggcagggaaugaaguucuccccaggcagugccuaaaccgcuauuacagcugaugacuucuguuguuua

SEQ ID NO: 2241 - RNA, 100 nt, Artificial sequence
  Synthetic polynucleotide
aauauuacugggaaugagguucucccaggaacgagauagaaauagcuaaaucuuucguucauaaccgcuugauuauaaagcugaugacuucugcaaagcg

SEQ ID NO: 2242 - RNA, 82 nt, Artificial sequence
  Synthetic polynucleotide
cuguuacccgggaaugaggucucccaugguaguguaauauuuaccagaaccgcuuaugacagcugauggcuucugcauugug

SEQ ID NO: 2243 - RNA, 73 nt, Artificial sequence
  Synthetic polynucleotide
aauaucaaagggaaugaaguacucccuugggaaaccuaaacugcuuauucaagcugaugacuucuacgauuuu

SEQ ID NO: 2244 - RNA, 73 nt, Artificial sequence
  Synthetic polynucleotide
cgaaugagagggaaugaaguucucccuagggaaaccagaacugcugaauauagcugaugacuucuacgauuau

SEQ ID NO: 2245 - RNA, 79 nt, Artificial sequence
  Synthetic polynucleotide
agaauaaacgggaaugaaguucucccgaaguaaccagauuacuugaaccgcuuuaaaagcugaugacuucugcgacgaa

SEQ ID NO: 2246 - RNA, 73 nt, Artificial sequence
  Synthetic polynucleotide
gaaacaaaugggaaugaaugucuccccgggaucaucccgaaccgcuuauuaagcugaugacuucugugauaac

SEQ ID NO: 2247 - RNA, 74 nt, Artificial sequence
  Synthetic polynucleotide
auccagaacgggaaugagguucucccacgauuuuugaucgaaaccgccaaaaggcugaugacuucugugcaugg

SEQ ID NO: 2248 - RNA, 74 nt, Artificial sequence
  Synthetic polynucleotide
aaagaaaaagggaaugaaguucucccucgaagagauucgaaaccgcuuauuaagcugaugacuucuguguaaug

SEQ ID NO: 2249 - RNA, 67 nt, Artificial sequence
  Synthetic polynucleotide
aagugaauaggugaugguguucgccuuuaaaugcuaacgaaagauagcuaaugacgccuacuaaagu

SEQ ID NO: 2250 - RNA, 67 nt, Artificial sequence; identical to SEQ ID NO: 2249
  Synthetic polynucleotide

SEQ ID NO: 2251 - RNA, 62 nt, Artificial sequence
  Synthetic polynucleotide
agccucacaggggauggcauucccccuugaaccgccauguggcuaaugaugccugcuuuuua

SEQ ID NO: 2252 - RNA, 60 nt, Artificial sequence
  Synthetic polynucleotide
aauccugccggugaugagauccaccguaaaccgcccgcugcuaaugacuucuacccggaa

SEQ ID NO: 2253 - RNA, 63 nt, Artificial sequence
  Synthetic polynucleotide
uuuuuuacaggagauggcauuccuccucauaaccgcccucuggcugaugaugccugcacauuc

SEQ ID NO: 2254 - RNA, 64 nt, Artificial sequence
  Synthetic polynucleotide
guacaugaugggaaugggguucucccgaaacugccagcaauuggcugaugacuccugcuugaau

SEQ ID NO: 2255 - RNA, 75 nt, Artificial sequence
  Synthetic polynucleotide
acuagcagcggcgauggggcucgccaggaagcucgacuucugaaccgccagccggcugauggcaccugcgaacaa

SEQ ID NO: 2256 - RNA, 73 nt, Artificial sequence
  Synthetic polynucleotide
cuuacugacgggaaugaaguucucccaagguuuuaccuaaacugcuuauaaagcugaugacuucugugaauua

SEQ ID NO: 2257 - RNA, 63 nt, Artificial sequence
  Synthetic polynucleotide
uugccgacaggagauggcauuccuccuucaaccgccccuggggcugaugaugccuacgcauga

SEQ ID NO: 2258 - RNA, 73 nt, Artificial sequence
  Synthetic polynucleotide
caacuucauggcgauggaguucgcccuaaccgccgcagccacguugcugcgugcugauaacuccugccgacac

SEQ ID NO: 2259 - RNA, 67 nt, Artificial sequence
  Synthetic polynucleotide
gcggcgaccggagauggcaugccuccguacaaccgccggcgagccggcugaugaugccuacgcguuc

SEQ ID NO: 2260 - RNA, 67 nt, Artificial sequence; identical to SEQ ID NO: 2259
  Synthetic polynucleotide

SEQ ID NO: 2261 - RNA, 106 nt, Artificial sequence
  Synthetic polynucleotide
cacuaaagcggagaugacauuccucccuacccuaacgccgccaaaaaugcuggcagccugaaguacaagguacaaccgccacccggcugaugaugucuacguccac

SEQ ID NO: 2262 - RNA, 62 nt, Artificial sequence
  Synthetic polynucleotide
ugcugcgcuggagauggcauucuccuuuaaccgcccuuauggcugaugaugccugcucgccc

SEQ ID NO: 2263 - RNA, 80 nt, Artificial sequence
  Synthetic polynucleotide
aaauauaaagggaaugagguucucccuaaguaauaaaauuacuuaaaccgcuuaugaaagcugaugacuucugcgaguaa

SEQ ID NO: 2264 - RNA, 67 nt, Artificial sequence; identical to SEQ ID NO: 2259
  Synthetic polynucleotide

SEQ ID NO: 2265 - RNA, 88 nt, Artificial sequence
  Synthetic polynucleotide
uuugggcgcggugauggaguucaccaucuacuacaaauauggaaaaccguccaacuucuuuagccggacuaauaacuccuaccuauaa

SEQ ID NO: 2266 - RNA, 60 nt, Artificial sequence
  Synthetic polynucleotide
auaauuauaggcgauggaguucgccauaaacgcugcuuagcuaaugacuccuaccaguau

SEQ ID NO: 2267 - RNA, 59 nt, Artificial sequence
  Synthetic polynucleotide
auaccauaaggcgauggagcucgccauaaaugcggaacgcugauggcuccuauuaggag

SEQ ID NO: 2268 - RNA, 63 nt, Artificial sequence
  Synthetic polynucleotide
aacauacuaggcgaugggguucgccauaaccaccggcuuccugcugaugacuccugcugcguu

SEQ ID NO: 2269 - RNA, 72 nt, Artificial sequence
  Synthetic polynucleotide
uguaguccguggaauggcguuuccacuaauucaaaccgccggcugaagcuggcugaugacgccugcuugaaa

SEQ ID NO: 2270 - RNA, 76 nt, Artificial sequence
  Synthetic polynucleotide
uguuuacaggggaaugagguucucccuuagugucauacuaaaaccgcuuauuuaagcugaugacuucugugugauu

SEQ ID NO: 2271 - RNA, 67 nt, Artificial sequence
  Synthetic polynucleotide
ccaaauacgggugauggauuuccaccuuuaaccgcucuauuuuagagauaaugauuccuacuauagc

SEQ ID NO: 2272 - RNA, 63 nt, Artificial sequence
  Synthetic polynucleotide
uagccggcaggagauggcauuccuccuucaaccgccccuggggcugaugaugccuacgcauga

SEQ ID NO: 2273 - RNA, 82 nt, Artificial sequence
  Synthetic polynucleotide
ccugaugacggcgauggaguccgccugaccggugugaucgacaccggcgaagugucaccuggcugauggcuccuaccuccca

SEQ ID NO: 2274 - RNA, 67 nt, Artificial sequence; identical to SEQ ID NO: 2259
  Synthetic polynucleotide

SEQ ID NO: 2275 - RNA, 96 nt, Artificial sequence
  Synthetic polynucleotide
gaaaucccuggcaauggaguuugccgucccgccgguucgaaguacuugggaaaaccuccuuucuugaaaagaaaggcugauaacuccuacuucaac

SEQ ID NO: 2276 - RNA, 65 nt, Artificial sequence
  Synthetic polynucleotide
agaagaacaggcgaugauguucgccgcaaaugauuguguagcaaucugaugacgucuacugaaac

SEQ ID NO: 2277 - RNA, 70 nt, Artificial sequence
  Synthetic polynucleotide
uguaacaauggugaugagguccacccugauaauugucaaaaccgcuuaugcugaugacuucuacacaacu

SEQ ID NO: 2278 - RNA, 70 nt, Artificial sequence
  Synthetic polynucleotide
uaaggaaccggcgauggaacccgccugaacucguuucgaaccgcacacugcugauaguuccuauacacga

SEQ ID NO: 2279 - RNA, 77 nt, Artificial sequence
  Synthetic polynucleotide
aaucuuuuugggaaugaaguucucccuuaguuuaaaacuaaaaccgcuuuuuauaggcugaugacuucuguguuuuu

SEQ ID NO: 2280 - RNA, 61 nt, Artificial sequence
  Synthetic polynucleotide
ccuggacaaggggaugggguuccccugaaaccgccgcaaggcugaugacuccucugugccg

SEQ ID NO: 2281 - RNA, 67 nt, Artificial sequence
  Synthetic polynucleotide
ccggcuugcggagauggcauaccucccuuaaccgccgaucaccucggcugaugaugccuacaaguuc

SEQ ID NO: 2282 - RNA, 69 nt, Artificial sequence
  Synthetic polynucleotide
ucgaaucaagggaaugggacuucccugugauaaaccgcuaaugaaguagcugauaguuccuaccggagc

SEQ ID NO: 2283 - RNA, 73 nt, Artificial sequence
  Synthetic polynucleotide
guaucacaaggugauggugcuccaccuuucccaaccgcccugauuuuuucgggcugaugacgccugauaaaac

SEQ ID NO: 2284 - RNA, 67 nt, Artificial sequence
  Synthetic polynucleotide
guuggccguggagauggcauuccucccuuaacugccgauucguucggcugaugaugccuacacaccc

SEQ ID NO: 2285 - RNA, 84 nt, Artificial sequence
  Synthetic polynucleotide
uagccaucaggugaugggguuccaccuaagcuuuugcuucaaccgcccguucuuuugaaccgugcuaaugacuccuacagaauc

SEQ ID NO: 2286 - RNA, 105 nt, Artificial sequence
  Synthetic polynucleotide
uacuaaagcggagaugacauuccucccuacccucgcgcagccaaaacgcugacagccuuaaaaacaggguacaaccgccacucggcuaaugaugucuacguccac

SEQ ID NO: 2287 - RNA, 63 nt, Artificial sequence
  Synthetic polynucleotide
auuuaauauggugaugguguucaccaauuuaaccgauuaauaucugacgacgccuacuuucuu

SEQ ID NO: 2288 - RNA, 64 nt, Artificial sequence
  Synthetic polynucleotide
cugcacgaugggaauggagcuucccgaaaccucccugcgaagggcugauggcuccugccuuggu

SEQ ID NO: 2289 - RNA, 62 nt, Artificial sequence
  Synthetic polynucleotide
ggccgcgccggcgaugggguucgccgugaaccgcccgcggggcugaugacuccuguuucgau

SEQ ID NO: 2290 - RNA, 69 nt, Artificial sequence
  Synthetic polynucleotide
acgucgcguggugguggaguccaccugaaccgccgcucugacuggacggccaaugacuccuacgcauag

SEQ ID NO: 2291 - RNA, 61 nt, Artificial sequence
  Synthetic polynucleotide
aaucagauaggcgauggaguucgccuuuaaccgccgcuuggcuaaugacuccugccgguua

SEQ ID NO: 2292 - RNA, 67 nt, Artificial sequence
  Synthetic polynucleotide
agugaauagguguaugguguucgccuuuaaaugcuaacgaaagauagcuaaugacgccuacuaaagu

SEQ ID NO: 2293 - RNA, 60 nt, Artificial sequence
  Synthetic polynucleotide
auaaucauaggugauggaguucgccauaaccgcugcuuagcuaaugacuccuaccaguau

SEQ ID NO: 2294 - RNA, 71 nt, Artificial sequence
  Synthetic polynucleotide
uaauaacuuggugaugggguucaccagaaacuuauuuucaaaccgcaauugcugauaacuccuauguuaua

SEQ ID NO: 2295 - RNA, 79 nt, Artificial sequence
  Synthetic polynucleotide
uagguuacuggggauggcgucccccagggcuuguucccgaaccgccugauacaugaaggcugaugacgccuaucucuug

SEQ ID NO: 2296 - RNA, 55 nt, Artificial sequence
  Synthetic polynucleotide
aaauuaaauggcgaugguguucgccuauacgcaaguugaugacaccuaccuugag

SEQ ID NO: 2297 - RNA, 67 nt, Artificial sequence
  Synthetic polynucleotide
cuaaaacagggagauggcauuccucccuugaaaaaccgccguauuggcuaaugaugccuacguuacc

SEQ ID NO: 2298 - RNA, 76 nt, Artificial sequence
  Synthetic polynucleotide
ggccaucucggagauggcguuccuccgcgcuguaccaucaaccguagcgaucgcuacugaugacgccuacaagaac

SEQ ID NO: 2299 - RNA, 62 nt, Artificial sequence
  Synthetic polynucleotide
aauaagccuggugauggaguccaccguuauuugccuuaaaggcugaugacuccuacuugaau

SEQ ID NO: 2300 - RNA, 62 nt, Artificial sequence
  Synthetic polynucleotide
cgucccgauggggauggaguuccccgaaaccgcccgucagggcugaugacuccuaccgcgaa

SEQ ID NO: 2301 - RNA, 67 nt, Artificial sequence; identical to SEQ ID NO: 2259
  Synthetic polynucleotide

SEQ ID NO: 2302 - RNA, 61 nt, Artificial sequence
  Synthetic polynucleotide
aacggcgauggggauggagucccccgacaaccgccgcgaggcugaugacuccuaccgggcg

SEQ ID NO: 2303 - RNA, 55 nt, Artificial sequence; identical to SEQ ID NO: 2296
  Synthetic polynucleotide

SEQ ID NO: 2304 - RNA, 71 nt, Artificial sequence; identical to SEQ ID NO: 2294
  Synthetic polynucleotide

SEQ ID NO: 2305 - RNA, 67 nt, Artificial sequence
  Synthetic polynucleotide
cgacagauaggagaugacauuccuccucgcaaaaaccgccguucuggcuaaugaugucuacguuacc

SEQ ID NO: 2306 - RNA, 66 nt, Artificial sequence
  Synthetic polynucleotide
ucugucaggggcgaugaaguccgccguaaccgccuuacccuaaaggcugaugacuucuguuuuaug

SEQ ID NO: 2307 - RNA, 74 nt, Artificial sequence
  Synthetic polynucleotide
uacaagcagggugauggagcucaccucaaccgcgcacucggcauggcccgaucgcugauggcuccuacaguucu

SEQ ID NO: 2308 - RNA, 69 nt, Artificial sequence
  Synthetic polynucleotide
caaagucaggggaaugggacuucccuguuauaaaccgcuaauaaaguagcugauaguuccugccggagu

SEQ ID NO: 2309 - RNA, 63 nt, Artificial sequence; identical to SEQ ID NO: 2257
  Synthetic polynucleotide

SEQ ID NO: 2310 - RNA, 77 nt, Artificial sequence
  Synthetic polynucleotide
ucgggauucggagauggcguuccuccgcgcaguuccaucaaaccguagcgauugcuacugaugacgccuacaagaac

SEQ ID NO: 2311 - RNA, 69 nt, Artificial sequence
  Synthetic polynucleotide
ggccgcacaggagauggcauuccuccucgaaccgcacgcacccugcgcgcugaugaugccugcccaccc

SEQ ID NO: 2312 - RNA, 60 nt, Artificial sequence
  Synthetic polynucleotide
auaaucauaggcgauggaguucgccauaaacgcugcuuagcuaaugacuccuaccaguau

SEQ ID NO: 2313 - RNA, 64 nt, Artificial sequence
  Synthetic polynucleotide
ugcugcaacggcgagggaguccgccgaacaaaugccaaugauggcugaugacuccuacaaauau

SEQ ID NO: 2314 - RNA, 75 nt, Artificial sequence
  Synthetic polynucleotide
auaaaugauggguauggugcacacccgaaaccgcuuuaagaauaaaaucuuaaaacuaauggcgccuacaaacaa

SEQ ID NO: 2315 - RNA, 70 nt, Artificial sequence
  Synthetic polynucleotide
uggagaaccggcgauggaacccgccugaacucguuucgaaccgcacacugcugauaguuccuacacacga

SEQ ID NO: 2316 - RNA, 61 nt, Artificial sequence
  Synthetic polynucleotide
aauauuuaaggugaugaagcccaccuuaauugccguaaaggcugauggcuucuacgaagau

SEQ ID NO: 2317 - RNA, 83 nt, Artificial sequence
  Synthetic polynucleotide
auuaugacgggagaugaugauccuccuuuaacugccuuacugaaguuuacccuucuuauaaggaugaugacgucuaacaacau

SEQ ID NO: 2318 - RNA, 60 nt, Artificial sequence; identical to SEQ ID NO: 2312
  Synthetic polynucleotide

SEQ ID NO: 2319 - RNA, 84 nt, Artificial sequence
  Synthetic polynucleotide
uagccaucaggugaugggguuccaccuaagcuuuugcuucaaccgcccguucuuucgaacagugcuaaugacuccuacagaauc

SEQ ID NO: 2320 - RNA, 60 nt, Artificial sequence
  Synthetic polynucleotide
aaauaauaaggugauggaguucaccauaaccgcagaaaugcuuaugacuccuacaaauaa

SEQ ID NO: 2321 - RNA, 60 nt, Artificial sequence; identical to SEQ ID NO: 2312
  Synthetic polynucleotide

SEQ ID NO: 2322 - RNA, 55 nt, Artificial sequence
  Synthetic polynucleotide
gaauuaaauggcgaugguguucgccuauacguaaguugaugacaccuaccuugua

SEQ ID NO: 2323 - RNA, 75 nt, Artificial sequence; identical to SEQ ID NO: 2255
  Synthetic polynucleotide

SEQ ID NO: 2324 - RNA, 76 nt, Artificial sequence
  Synthetic polynucleotide
ggauuugacggcgauggagcucgccaggauuaaauuccaaacugcuuucuuagaagcuaauggcuccuacccuauc

SEQ ID NO: 2325 - RNA, 64 nt, Artificial sequence
  Synthetic polynucleotide
augcucauaggcgauggaguucgccauuaaccacuggauaacaguuaaugacuccugcgaaaca

SEQ ID NO: 2326 - RNA, 76 nt, Artificial sequence
  Synthetic polynucleotide
cuuuuagaagggaaugaaguucucccuuagugaucauacuagaaccgcuuauaaagcugaugacuucugcgaauaa

SEQ ID NO: 2327 - RNA, 68 nt, Artificial sequence
  Synthetic polynucleotide
auuauggcgggagaugauguuccuccuuaaaccgccuuucaaucaaggauaaugacgucuaacaacau

SEQ ID NO: 2328 - RNA, 65 nt, Artificial sequence; identical to SEQ ID NO: 2276
  Synthetic polynucleotide

SEQ ID NO: 2329 - RNA, 67 nt, Artificial sequence; identical to SEQ ID NO: 2259
  Synthetic polynucleotide

SEQ ID NO: 2330 - RNA, 79 nt, Artificial sequence
  Synthetic polynucleotide
gaggcagaaggcaauggauucugccugaccguucccggucgaaccgcuucauccggaagcugaugauuccugucccucg

SEQ ID NO: 2331 - RNA, 73 nt, Artificial sequence
  Synthetic polynucleotide
auuucuauagggaaugaaguucucccuuggcaauagccuaaaccgcaaauaugcugaugacuucugcgaaaau

SEQ ID NO: 2332 - RNA, 73 nt, Artificial sequence
  Synthetic polynucleotide
aggcagaaagggaaugaaguucucccccgauuuuuaucgaaaccgccaaugagcugaugacuucugugcaaug

SEQ ID NO: 2333 - RNA, 67 nt, Artificial sequence; identical to SEQ ID NO: 2259
  Synthetic polynucleotide

SEQ ID NO: 2334 - RNA, 65 nt, Artificial sequence
  Synthetic polynucleotide
uucuauugcggagauggcauuccucccguaaccaccccuagaggguugaugaugccuacgguauu

SEQ ID NO: 2335 - RNA, 75 nt, Artificial sequence
  Synthetic polynucleotide
ggcuuuucgggcgauggcguccgcccgggcuucgagccgaaccgcccguuuugggcugaugacgccuguucucug

SEQ ID NO: 2336 - RNA, 75 nt, Artificial sequence
  Synthetic polynucleotide
aauaaugauggguauggugcacacccgaaaccgcuuuaagaauaaaaucuuaaaacuaauggcgccuacaaacaa

SEQ ID NO: 2337 - RNA, 64 nt, Artificial sequence
  Synthetic polynucleotide
aucacaaguggcgauggaguccgccauauaauugccgauaaaggcugaugacuccuacuuaugu

SEQ ID NO: 2338 - RNA, 74 nt, Artificial sequence
  Synthetic polynucleotide
uaauaacuuggugaugggguucaccagaaacuuauuuucaaaccgcaaaaauugcugauaacuccuauguuaua

SEQ ID NO: 2339 - RNA, 64 nt, Artificial sequence
  Synthetic polynucleotide
ucaagaucuggagaugacacgccuccauaaccgcccuaacaaggcuaaugaugucuacgugacc

SEQ ID NO: 2340 - RNA, 63 nt, Artificial sequence
  Synthetic polynucleotide
cuuugcaccggcuaugggauuagccuuuaaccgcccuuuggagcugaugaucccuacaauuug

SEQ ID NO: 2341 - RNA, 69 nt, Artificial sequence
  Synthetic polynucleotide
aacgauaacggcgaugggguucgccagucaaaccacucgcggcggcgaguugaugaccccuacuucgag

SEQ ID NO: 2342 - RNA, 78 nt, Artificial sequence
  Synthetic polynucleotide
cuggacugcggugaugggacucgccugaagccguuacaggcuucgaaccgcaaacccgcugaugguuccuacgacaua

SEQ ID NO: 2343 - RNA, 60 nt, Artificial sequence; identical to SEQ ID NO: 2312
  Synthetic polynucleotide

SEQ ID NO: 2344 - RNA, 70 nt, Artificial sequence
  Synthetic polynucleotide
uagcaacauggugaugguguucaccacgaacuauuuauuggacgaauaaauuaaugacgccuaccaaacg

SEQ ID NO: 2345 - RNA, 73 nt, Artificial sequence
  Synthetic polynucleotide
auauuagaagggaaugaaguucucccuuagaaaaaucuaaaaccgcauuuaugcugaugacuucuguaacuau

SEQ ID NO: 2346 - RNA, 81 nt, Artificial sequence
  Synthetic polynucleotide
gguuccuugggcgauggcgcccgcccggggcuucgagcccgaaccgccucccguugggaggcugauggcgccuauucugua

SEQ ID NO: 2347 - RNA, 60 nt, Artificial sequence; identical to SEQ ID NO: 2312
  Synthetic polynucleotide

SEQ ID NO: 2348 - RNA, 65 nt, Artificial sequence
  Synthetic polynucleotide
ggcguacaaggugauggggugccaccuacuuaaccgccaauuuggcugaugacuccuacaguaaa

SEQ ID NO: 2349 - RNA, 75 nt, Artificial sequence
  Synthetic polynucleotide
uaaauaaaagggaaugagguucucccucgauuuaaucgaaaccgcuuauaacaagcugaugacuucugugcaaua

SEQ ID NO: 2350 - RNA, 76 nt, Artificial sequence
  Synthetic polynucleotide
uaccauuuugggaaugaaugucucccuuagcauacugcuuaaaccgcuuauuaaagcugaugacuucugcgcauag

SEQ ID NO: 2351 - RNA, 63 nt, Artificial sequence
  Synthetic polynucleotide
guaaaccagggugaugggguucaccuguaaccgcuuuuuccagcugaugacuccucuuccugu

SEQ ID NO: 2352 - RNA, 73 nt, Artificial sequence
  Synthetic polynucleotide
cggcgcauuggagauggcauuccuccauuaacaaaccgcugcgcccguagcagcugaugaugccuacagaaac

SEQ ID NO: 2353 - RNA, 105 nt, Artificial sequence; identical to SEQ ID NO: 2286
  Synthetic polynucleotide

SEQ ID NO: 2354 - RNA, 76 nt, Artificial sequence
  Synthetic polynucleotide
aauaguggcgggaaugaagugcucccuucauaugauaugaaaaccgcaaacacgugcugaugacuucuacgauuuu

SEQ ID NO: 2355 - RNA, 64 nt, Artificial sequence
  Synthetic polynucleotide
cguccggucggagauggaguaccuccguauaaccgcccccagggcugaugacuccugcucgcau

SEQ ID NO: 2356 - RNA, 62 nt, Artificial sequence
  Synthetic polynucleotide
uagcucauaggugauaaggcucaccguugaacugcccgcgggcugauggccucuacagaagu

SEQ ID NO: 2357 - RNA, 75 nt, Artificial sequence
  Synthetic polynucleotide
aaugggcacggugauggggugccaccggaaucgaaagauucgaaccgcuuuaaagcuaaugacuccuacagaaac

SEQ ID NO: 2358 - RNA, 78 nt, Artificial sequence; identical to SEQ ID NO: 2342
  Synthetic polynucleotide

SEQ ID NO: 2359 - RNA, 63 nt, Artificial sequence
  Synthetic polynucleotide
ucgaacgacggagaugacauuccuccuuaaccgccuucacgggcugaugaugucuacguaacc

SEQ ID NO: 2360 - RNA, 65 nt, Artificial sequence; identical to SEQ ID NO: 2276
  Synthetic polynucleotide

SEQ ID NO: 2361 - RNA, 62 nt, Artificial sequence
  Synthetic polynucleotide
acugaacgcggcgaugaagcccgccgacaaugcgccgcccggcugauggcuucuaccgaguu

SEQ ID NO: 2362 - RNA, 67 nt, Artificial sequence; identical to SEQ ID NO: 2259
  Synthetic polynucleotide

SEQ ID NO: 2363 - RNA, 67 nt, Artificial sequence; identical to SEQ ID NO: 2259
  Synthetic polynucleotide

SEQ ID NO: 2364 - RNA, 60 nt, Artificial sequence; identical to SEQ ID NO: 2312
  Synthetic polynucleotide

SEQ ID NO: 2365 - RNA, 72 nt, Artificial sequence
  Synthetic polynucleotide
cuaacaaaaggagauggcauuccuccuguuuaaaaaccguccaaauaaagggcugaugaugccugcguucac

SEQ ID NO: 2366 - RNA, 70 nt, Artificial sequence; identical to SEQ ID NO: 2237
  Synthetic polynucleotide

SEQ ID NO: 2367 - RNA, 60 nt, Artificial sequence
  Synthetic polynucleotide
uauauauuaggugauggaguucgccuuuaaacgcguaaugcuaaugacuccuacaaaaaa

SEQ ID NO: 2368 - RNA, 60 nt, Artificial sequence
  Synthetic polynucleotide
aaauuuaauggcgauggggcucgccuaacgcucaucugagcuaauagcuccuaccgaaag

SEQ ID NO: 2369 - RNA, 71 nt, Artificial sequence
  Synthetic polynucleotide
uugcggcgaggugauggcguuccaccuuacccaaccgcuuccccugagaagcugaugacgccugauauuac

SEQ ID NO: 2370 - RNA, 79 nt, Artificial sequence
  Synthetic polynucleotide
guucuuuggggugauggcgccgcccggggcuucgagccgaaccgccucccguugggaggcugauggcgccuauucugua

SEQ ID NO: 2371 - RNA, 73 nt, Artificial sequence
  Synthetic polynucleotide
auaguagauggguauggugcacacccgaaaccguuucaagaaauagcuugaaucuaauggcgccuacaaagca

SEQ ID NO: 2372 - RNA, 60 nt, Artificial sequence; identical to SEQ ID NO: 2312
  Synthetic polynucleotide

SEQ ID NO: 2373 - RNA, 59 nt, Artificial sequence
  Synthetic polynucleotide
cauuuauaaggugauggggcccaccaaaccgccgcaaggcugauggcuccuuuugaaaa

SEQ ID NO: 2374 - RNA, 80 nt, Artificial sequence
  Synthetic polynucleotide
uuuagcgauggugauggagcucaccgaaaccgcccaggauuuuucuuaauugcaccucggcuaauggcuccuacgcuucc

SEQ ID NO: 2375 - RNA, 64 nt, Artificial sequence
  Synthetic polynucleotide
gaccgcgauggggauggggcucccccgauaaccgccugagaaggcugauggcuccugccaggac

SEQ ID NO: 2376 - RNA, 64 nt, Artificial sequence
  Synthetic polynucleotide
aaaacguguggcgauggaguccgcccaauaaccgccuuuauaggcugaugacugcuacugaucc

SEQ ID NO: 2377 - RNA, 66 nt, Artificial sequence
  Synthetic polynucleotide
uuuuuuaacggcgaugaaguccgccuccaaccgccacguaucgugacugaugacuucuaccgggga

SEQ ID NO: 2378 - RNA, 75 nt, Artificial sequence
  Synthetic polynucleotide
aguucacaaggugaugguguuccaccuuucccaaccgccgguucgcucgaaucggaugaugacgccugauauaca

SEQ ID NO: 2379 - RNA, 67 nt, Artificial sequence
  Synthetic polynucleotide
uagggcaaaggagauggcauuccuccuguaacaaaccgccauuguggcuaaugaugccuacguuacu

SEQ ID NO: 2380 - RNA, 79 nt, Artificial sequence
  Synthetic polynucleotide
gucggcgcaggcaauggauuucugccugaccguccgggucgaaccgccucuuucgggggcugaugauuccuacccaccg

SEQ ID NO: 2381 - RNA, 83 nt, Artificial sequence
  Synthetic polynucleotide
auaugcauuggcaaugggguuugccuucucggucaacgagagaaccgccugauuauuucggugcugauaacuccuauugguac

SEQ ID NO: 2382 - RNA, 67 nt, Artificial sequence
  Synthetic polynucleotide
uugaauugcggcgaugaaguucgcccugaaccgccccgggccaggggaugaugacuucuacuucgaa

SEQ ID NO: 2383 - RNA, 74 nt, Artificial sequence
  Synthetic polynucleotide
aaagaaaaagggaaugaaguucucccucgaagagauucgaaaccgcuuauuaagcugaugacuucugugcgaug

SEQ ID NO: 2384 - RNA, 55 nt, Artificial sequence; identical to SEQ ID NO: 2296
  Synthetic polynucleotide

SEQ ID NO: 2385 - RNA, 60 nt, Artificial sequence
  Synthetic polynucleotide
auaccauaaggugauggagcucgccauaaaugcggaaacgcugauggcuccuauuaggag

SEQ ID NO: 2386 - RNA, 60 nt, Artificial sequence; identical to SEQ ID NO: 2312
  Synthetic polynucleotide

SEQ ID NO: 2387 - RNA, 84 nt, Artificial sequence
  Synthetic polynucleotide
auuaugacgggagaugauguuccuccuuuaacugccuuacugaaguuuacccuucuuaauaaggaugaugacgucuaacaacau

SEQ ID NO: 2388 - RNA, 79 nt, Artificial sequence; identical to SEQ ID NO: 2380
  Synthetic polynucleotide

SEQ ID NO: 2389 - RNA, 65 nt, Artificial sequence
  Synthetic polynucleotide
ucaaucacaggcaaugaggucugccucaaaccgcuucuuagcaagcugaugacuucuacuuaacc

SEQ ID NO: 2390 - RNA, 67 nt, Artificial sequence; identical to SEQ ID NO: 2259
  Synthetic polynucleotide

SEQ ID NO: 2391 - RNA, 63 nt, Artificial sequence
  Synthetic polynucleotide
aaucgaauaggcgauggaguucgccauaaccgccggcuuccggcugaugacuccugcugcaaa

SEQ ID NO: 2392 - RNA, 59 nt, Artificial sequence
  Synthetic polynucleotide
ugaauaaaaggugauggaguucaccugaaaugcguaaugcugaugacuccuacaggaau

SEQ ID NO: 2393 - RNA, 62 nt, Artificial sequence
  Synthetic polynucleotide
uugcgcgcuggagauggcauucucccuuaaccgcccucguggcugaugaugccugcuucguc

SEQ ID NO: 2394 - RNA, 86 nt, Artificial sequence
  Synthetic polynucleotide
cagguuuaaggagauggcguucuccuugaugcucauaaaagcaucaaaaccgccucacauauaaggcuaauaacgccuaccugcuc

SEQ ID NO: 2395 - RNA, 63 nt, Artificial sequence
  Synthetic polynucleotide
auauuuucuggcgauggggcucgccuuaauuuugcugaaaaagcugauagcuccuacccguaa

SEQ ID NO: 2396 - RNA, 62 nt, Artificial sequence
  Synthetic polynucleotide
gaaggucaaggggauggagucccccaugaaccgcauguuuugcugaugacuccugccggacc

SEQ ID NO: 2397 - RNA, 63 nt, Artificial sequence
  Synthetic polynucleotide
cauccugcaggugauggaguccaccuuuaaccgcuuuuucuggcugaugacuccugcauaaua

SEQ ID NO: 2398 - RNA, 64 nt, Artificial sequence; identical to SEQ ID NO: 2339
  Synthetic polynucleotide

SEQ ID NO: 2399 - RNA, 61 nt, Artificial sequence
  Synthetic polynucleotide
aauugaauaggcgaugacggucgccauuaaacgagcaaaaucuaaugacgucuacuauuua

SEQ ID NO: 2400 - RNA, 66 nt, Artificial sequence
  Synthetic polynucleotide
ucccgacaaggggauggagcucccccuucaaccgcccucgcaagggcugauggcuccuaccgcgac

SEQ ID NO: 2401 - RNA, 73 nt, Artificial sequence
  Synthetic polynucleotide
ccugugcagggugauggcguuccaccuuauuccaaccgccucguuucaguaggcugaugacgccugauaugac

SEQ ID NO: 2402 - RNA, 63 nt, Artificial sequence
  Synthetic polynucleotide
auuauaauaggugauggcguucaccaauuuaaccgauuaagaucugacgacgccuacuuucuu

SEQ ID NO: 2403 - RNA, 60 nt, Artificial sequence
  Synthetic polynucleotide
gacgauacugggaauggggucucccgaaaccgccgaaaggcugaugacuccuaccgcgua

SEQ ID NO: 2404 - RNA, 64 nt, Artificial sequence
  Synthetic polynucleotide
cuuuccccaggagaugaaauuacucuuuauaaccgccgcucuggcugaugaugucuacguucau

SEQ ID NO: 2405 - RNA, 79 nt, Artificial sequence
  Synthetic polynucleotide
cuuaccgguggcgaugggacucgccuggggccugcaaggauucccgaaccgcaauuccgcugaugguuccuauugacgc

SEQ ID NO: 2406 - RNA, 62 nt, Artificial sequence
  Synthetic polynucleotide
ucugcuucgggugauggcguccaccccgaaacgcccgcguggcugaugacgccuuuucgcau

SEQ ID NO: 2407 - RNA, 67 nt, Artificial sequence
  Synthetic polynucleotide
uuaaaacagggagauggcauuccucccuugaaaaaccgccguauuggcuaaugaugccuacguuacc

SEQ ID NO: 2408 - RNA, 61 nt, Artificial sequence
  Synthetic polynucleotide
ugucauacuggugauggaguucaccaaaaccgccguucgggcugauaacuccuacaggaug

SEQ ID NO: 2409 - RNA, 78 nt, Artificial sequence
  Synthetic polynucleotide
cgcacagauggggauggagucccccgacaaccgcccggcgguaggugaccgugaugggcugaugacuccugcuugagg

SEQ ID NO: 2410 - RNA, 62 nt, Artificial sequence
  Synthetic polynucleotide
uucgcggcuggagaucgcauucuccauuaaccgccccuggggcugaugaugccugcuacgcc

SEQ ID NO: 2411 - RNA, 78 nt, Artificial sequence
  Synthetic polynucleotide
ccccguuguggagauggcaugccucccuuaaccgccgguuagcgcguaacgauaccggcugaugaugccuacaaguuc

SEQ ID NO: 2412 - RNA, 82 nt, Artificial sequence
  Synthetic polynucleotide
auuacuaauggcgauggaguucgccaaaaccgcuauucuagucaaaaaauuaaucuagaaggcugaugacuccuacuuuucu

SEQ ID NO: 2413 - RNA, 83 nt, Artificial sequence
  Synthetic polynucleotide
gcccguaacggcaauggauuucugccgcccgagugaucggggaaccgcuugguaacggccaggcugaugauuccuguuuucac

SEQ ID NO: 2414 - RNA, 63 nt, Artificial sequence; identical to SEQ ID NO: 2257
  Synthetic polynucleotide

SEQ ID NO: 2415 - RNA, 77 nt, Artificial sequence; identical to SEQ ID NO: 2310
  Synthetic polynucleotide

SEQ ID NO: 2416 - RNA, 74 nt, Artificial sequence
  Synthetic polynucleotide
aaagagaaagggaaugaaguucucccucgaagagauucgaaaccgcuuauuaagcugaugacuucuguguaaug

SEQ ID NO: 2417 - RNA, 66 nt, Artificial sequence
  Synthetic polynucleotide
uugccuaagggaaaugguguccuuccaauuuaaccgcuuuuagaagcugauggcgccugcaaugau

SEQ ID NO: 2418 - RNA, 71 nt, Artificial sequence
  Synthetic polynucleotide
aggaagacaggcgaugggguucgccaaaaccgccccggagaacagcgggagcugaugaccccuacuccauu

SEQ ID NO: 2419 - RNA, 60 nt, Artificial sequence
  Synthetic polynucleotide
aaugaauacggcgauggaguucgccacaaccgcugcuuagcuaaugacuccuaccaggau

SEQ ID NO: 2420 - RNA, 60 nt, Artificial sequence
  Synthetic polynucleotide
ugcauaaaaagugauggaacccacuuuaaccgccgaaaggcugaugguuccuacuuguga

SEQ ID NO: 2421 - RNA, 67 nt, Artificial sequence; identical to SEQ ID NO: 2407
  Synthetic polynucleotide

SEQ ID NO: 2422 - RNA, 67 nt, Artificial sequence; identical to SEQ ID NO: 2259
  Synthetic polynucleotide

SEQ ID NO: 2423 - RNA, 81 nt, Artificial sequence
  Synthetic polynucleotide
guucucuugggcgauggcgcccgcccggggcuucgagcccgaaccgccucccauggggaggcugauggcgccuauucuuga

SEQ ID NO: 2424 - RNA, 61 nt, Artificial sequence
  Synthetic polynucleotide
gaaaucgauggggauggaguuccccgauacccgccgcaaggcugaugacuccuaccgggcg

SEQ ID NO: 2425 - RNA, 59 nt, Artificial sequence; identical to SEQ ID NO: 2373
  Synthetic polynucleotide

SEQ ID NO: 2426 - RNA, 69 nt, Artificial sequence
  Synthetic polynucleotide
aaguccgaaggcgguggaguccgccacaaccgucaugcgccugccguggccaaugacuccugcgggguu

SEQ ID NO: 2427 - RNA, 85 nt, Artificial sequence
  Synthetic polynucleotide
aaugaaguaggggauggcgucccccuggggauaaccccgaaccgccucuugauuaaugauaggggcugaugacgccuacuucacc

SEQ ID NO: 2428 - RNA, 65 nt, Artificial sequence
  Synthetic polynucleotide
ugcaaccaaggugaugggguuccaccuacuuaaccgccaaaucggcugaugacuccuacaguuuc

SEQ ID NO: 2429 - RNA, 71 nt, Artificial sequence
  Synthetic polynucleotide
uauccuauaggugaugaaguccgccaagauuuacagucuaaaccgcuuaugcugaugacuucuacauuaau

SEQ ID NO: 2430 - RNA, 62 nt, Artificial sequence
  Synthetic polynucleotide
aaucgauugggugaugaggcucacccucaacugccauuacggcugauagccucuacagggaa

SEQ ID NO: 2431 - RNA, 76 nt, Artificial sequence
  Synthetic polynucleotide
auugggguuggugauggggugccaccggaaucgaaugauucaaaccgcuuguauagcugaugacuccuacagagac

SEQ ID NO: 2432 - RNA, 60 nt, Artificial sequence; identical to SEQ ID NO: 2312
  Synthetic polynucleotide

SEQ ID NO: 2433 - RNA, 64 nt, Artificial sequence; identical to SEQ ID NO: 2339
  Synthetic polynucleotide

SEQ ID NO: 2434 - RNA, 76 nt, Artificial sequence
  Synthetic polynucleotide
aaugcacacggugauggggugccaccagaaucgaaagauucaaaccgcuuuuacagcugaugacuccuacagaaac

SEQ ID NO: 2435 - RNA, 68 nt, Artificial sequence
  Synthetic polynucleotide
ggccgcacaggagauggcauuccuccucgaaccgcacgcacccgcgcgcugaugaugccugcccaccc

SEQ ID NO: 2436 - RNA, 63 nt, Artificial sequence
  Synthetic polynucleotide
uugcgcgcuggagauggcauucuccauuaaccgcccuugauggcugaugaugccugcuucgcc

SEQ ID NO: 2437 - RNA, 69 nt, Artificial sequence
  Synthetic polynucleotide
uugcaauacggaaaugguguccuuccgauucaaccgcuuuuuucaaaagcugauggcgccuacaauaga

SEQ ID NO: 2438 - RNA, 65 nt, Artificial sequence
  Synthetic polynucleotide
aaccccaagggaaauggugucuucccugcacaaaccgcuugaaagcugaugacgccuucaaaucg

SEQ ID NO: 2439 - RNA, 71 nt, Artificial sequence
  Synthetic polynucleotide
uaauaacuuggugaugggguucaccagaaacuuauuuucaaaccgcaauugcugauaacuccuagguuaua

SEQ ID NO: 2440 - RNA, 71 nt, Artificial sequence
  Synthetic polynucleotide
cauguuaacgggaauggaguucucccgguaaccgccugucgauuuuucaggcugaugacuccuguaugagg

SEQ ID NO: 2441 - RNA, 73 nt, Artificial sequence
  Synthetic polynucleotide
auaaguaccgggaaugaaguucucccuuagucugacuagaaccgcuuauaaagcugaugacuucugcauuaug

SEQ ID NO: 2442 - RNA, 60 nt, Artificial sequence
  Synthetic polynucleotide
auaaucagaggcgauggaguucgccauaacugcugcuuagcuaaugacuccuaccaguau

SEQ ID NO: 2443 - RNA, 67 nt, Artificial sequence; identical to SEQ ID NO: 2259
  Synthetic polynucleotide

SEQ ID NO: 2444 - RNA, 64 nt, Artificial sequence
  Synthetic polynucleotide
ggcgacgauggggauggggcucccccgauaaccgccugagaaggcugauggcuccugccaagac

SEQ ID NO: 2445 - RNA, 79 nt, Artificial sequence
  Synthetic polynucleotide
gaauauagaggcgauggaguucgccuuaaauugccacaagaaugaaaaauaccuuguggcugauaacuccuguccguau

SEQ ID NO: 2446 - RNA, 67 nt, Artificial sequence
  Synthetic polynucleotide
auaauaauuggagauggcauuccuccauuaaccgccgcaaucuguggcugaugaugccuacgacugg

SEQ ID NO: 2447 - RNA, 65 nt, Artificial sequence
  Synthetic polynucleotide
agcaacacaggcgauggcaugcgccuugaaccgccccgcguccggcugauuaugccuaccuuccc

SEQ ID NO: 2448 - RNA, 61 nt, Artificial sequence
  Synthetic polynucleotide
cuggaaacagggaauggugucucccuuucaccgccgacuggcugaugacuccugcugacug

SEQ ID NO: 2449 - RNA, 76 nt, Artificial sequence
  Synthetic polynucleotide
cucuuauugggcgauggggcucgccgaccguuaaccgccguucuuuucaaagaaggcugauagcuccuaccucuaa

SEQ ID NO: 2450 - RNA, 75 nt, Artificial sequence
  Synthetic polynucleotide
gugaaucaggggaaugaagugcuccccggggcguggccccgaaccgcguuugacgcugaugacuucugcauuuug

SEQ ID NO: 2451 - RNA, 106 nt, Artificial sequence
  Synthetic polynucleotide
uugcgugcuggagauggcauucuccaauggguguccggcgugcgcuucaacacacgcgcucgcgcgaacccauuaaccgccucgugcugaugaugccugcuucccc

SEQ ID NO: 2452 - RNA, 62 nt, Artificial sequence
  Synthetic polynucleotide
uucaagaaaggcuaugacguuagccuuuaagcgcccuccgggcugauaacgucugaucuuua

SEQ ID NO: 2453 - RNA, 67 nt, Artificial sequence
  Synthetic polynucleotide
gcagcgcaaagagauggcgugccucuaaaaccgccgcacuagugcggcugaugacgccuacagaacc

SEQ ID NO: 2454 - RNA, 76 nt, Artificial sequence
  Synthetic polynucleotide
aauggguucggugaugggguaccaccggaaucgaaagauucgaaccgcuguuaaagcuaaugacuccuacagaaac

SEQ ID NO: 2455 - RNA, 61 nt, Artificial sequence
  Synthetic polynucleotide
gaaaucgauggggauggagucccccgauaaccgccgcaaggcugaugacuccuaccgggcg

SEQ ID NO: 2456 - RNA, 73 nt, Artificial sequence
  Synthetic polynucleotide
auaauagauggguauggugcacacccgaaaccguuucaagaaauaacuugaaucuaauggcgccuacaaagca

SEQ ID NO: 2457 - RNA, 75 nt, Artificial sequence
  Synthetic polynucleotide
augacgaggggugauggaguccaccugaacggcccuuucuuucauaaggaaagggaugaugacuccugugagaga

SEQ ID NO: 2458 - RNA, 67 nt, Artificial sequence; identical to SEQ ID NO: 2281
  Synthetic polynucleotide

SEQ ID NO: 2459 - RNA, 67 nt, Artificial sequence
  Synthetic polynucleotide
ccggccugcggagauggcaugccucccuuaaccgccgaucccaucggcugaugaugccuacagguuc

SEQ ID NO: 2460 - RNA, 67 nt, Artificial sequence
  Synthetic polynucleotide
gucacgcguggagauggcauuccuccuuuaaccgccgauucgcucggcugaugaugccuacgugccc

SEQ ID NO: 2461 - RNA, 64 nt, Artificial sequence
  Synthetic polynucleotide
aacccaacgggcgaugaggcccgcccaaacugcccugaagagggcugauggccucuacuggcuu

SEQ ID NO: 2462 - RNA, 60 nt, Artificial sequence; identical to SEQ ID NO: 2420
  Synthetic polynucleotide

SEQ ID NO: 2463 - RNA, 69 nt, Artificial sequence
  Synthetic polynucleotide
uaaccacaaggagauggcguucuccuuuaagcgccuccuucaaaagaggcugauaacgccuacaagcuc

SEQ ID NO: 2464 - RNA, 73 nt, Artificial sequence
  Synthetic polynucleotide
uucgucaggcgcgauggaucucgccagggcuugucccgaaccgccacugacggcugauaguuccuguguugau

SEQ ID NO: 2465 - RNA, 66 nt, Artificial sequence
  Synthetic polynucleotide
auacguaaaggugaugggguuccaccuacuuaaccgccaauguuggcugaugacuccuacagaaua

SEQ ID NO: 2466 - RNA, 61 nt, Artificial sequence; identical to SEQ ID NO: 2316
  Synthetic polynucleotide

SEQ ID NO: 2467 - RNA, 62 nt, Artificial sequence
  Synthetic polynucleotide
auuguugauggggauggaguucccccgauaaccgccgcaaggcugaugacuccuaccggacg

SEQ ID NO: 2468 - RNA, 82 nt, Artificial sequence
  Synthetic polynucleotide
guuacuaauggcgauggaguucgcccaaaccgcuauucuagucaaaaaauaaaucuagaaggcugaugacuccuacuacucu

SEQ ID NO: 2469 - RNA, 61 nt, Artificial sequence
  Synthetic polynucleotide
gcgcgcgccggagauggcauucuccuuaaccgcccucguggcugaugaugccugcuucgcc

SEQ ID NO: 2470 - RNA, 106 nt, Artificial sequence
  Synthetic polynucleotide
ccggcaaccggcgauggaguucgccgcaaccgccucacuuggaauuuuucuauagaggaagaggguucuaaccucaaaagcugaggcugaugacuccuacacuucu

SEQ ID NO: 2471 - RNA, 67 nt, Artificial sequence
  Synthetic polynucleotide
agaaacgauggggauggggucccccgacaaccgccgcacuggacaggcugaugacuccugccgauac

SEQ ID NO: 2472 - RNA, 62 nt, Artificial sequence
  Synthetic polynucleotide
aagggaauacgcgauggaguucgcgguaaagccguuuugcggaugaugacuccuacucgauu

SEQ ID NO: 2473 - RNA, 76 nt, Artificial sequence
  Synthetic polynucleotide
uucagcgcgggcgauggcguccgcccggggcuucgagcccgaaccgcucgaaagggcugaugacgccuguucuacu

SEQ ID NO: 2474 - RNA, 62 nt, Artificial sequence
  Synthetic polynucleotide
uaaguuugcggcgauggaguucgccauaaguccgcauaagcgguaaugacuccuaccaggac

SEQ ID NO: 2475 - RNA, 67 nt, Artificial sequence; identical to SEQ ID NO: 2259
  Synthetic polynucleotide

SEQ ID NO: 2476 - RNA, 90 nt, Artificial sequence
  Synthetic polynucleotide
gaguccgcaggcgauggaucuccgccgagacgaccgaccuaugggccgucugaaccgccccgguccggggcugaugguuccuuccccacg

SEQ ID NO: 2477 - RNA, 60 nt, Artificial sequence; identical to SEQ ID NO: 2442
  Synthetic polynucleotide

SEQ ID NO: 2478 - RNA, 85 nt, Artificial sequence
  Synthetic polynucleotide
auuauaaaagggaaugagguucuccucuggaaaaccugaaugggcaaccuaaacugcuaauauagcugaugacuucuacgauuau

SEQ ID NO: 2479 - RNA, 64 nt, Artificial sequence; identical to SEQ ID NO: 2339
  Synthetic polynucleotide

SEQ ID NO: 2480 - RNA, 63 nt, Artificial sequence
  Synthetic polynucleotide
uccgaugccggugauggaguucaccguguaaccgcccguggggccgaugacuccuguucauau

SEQ ID NO: 2481 - RNA, 62 nt, Artificial sequence
  Synthetic polynucleotide
aucugcacaggagauggcauuccuccuugaaaccgccucgugcugaugaugccuacguaaac

SEQ ID NO: 2482 - RNA, 66 nt, Artificial sequence; identical to SEQ ID NO: 2465
  Synthetic polynucleotide

SEQ ID NO: 2483 - RNA, 62 nt, Artificial sequence
  Synthetic polynucleotide
auaauccuaggcgauggaguucgccauaaacgcgcugcuuaucuuaugacuccuaccaguau

SEQ ID NO: 2484 - RNA, 69 nt, Artificial sequence
  Synthetic polynucleotide
gucuuguuaggagauggcauuccuccuaguuuaaccguccuuuuguggacugaugaugccuacguaaac

SEQ ID NO: 2485 - RNA, 61 nt, Artificial sequence
  Synthetic polynucleotide
gacaucgauggggauggaguuccccgauacccgccgcaaggcugaugacuccuaccgggcg

SEQ ID NO: 2486 - RNA, 101 nt, Artificial sequence
  Synthetic polynucleotide
ccggcaacgggcgaugggguucgccgcaaccgccucaggcagauccuagggauaaaguuucucuaagacuuagagcuggggcugaugacuccuacucuucu

SEQ ID NO: 2487 - RNA, 62 nt, Artificial sequence
  Synthetic polynucleotide
aucgguaugggugauggcguccaccuucaaccgccgcuaaggcugaugacgccuguucucag

SEQ ID NO: 2488 - RNA, 67 nt, Artificial sequence; identical to SEQ ID NO: 2259
  Synthetic polynucleotide

SEQ ID NO: 2489 - RNA, 78 nt, Artificial sequence; identical to SEQ ID NO: 2342
  Synthetic polynucleotide

SEQ ID NO: 2490 - RNA, 70 nt, Artificial sequence; identical to SEQ ID NO: 2344
  Synthetic polynucleotide

SEQ ID NO: 2491 - RNA, 62 nt, Artificial sequence; identical to SEQ ID NO: 2406
  Synthetic polynucleotide

SEQ ID NO: 2492 - RNA, 72 nt, Artificial sequence
  Synthetic polynucleotide
gaagcuuucggagauggcauuccucccguaaccgcccugcauucccgcagagcugaugaugccuacgaguuc

SEQ ID NO: 2493 - RNA, 67 nt, Artificial sequence; identical to SEQ ID NO: 2259
  Synthetic polynucleotide

SEQ ID NO: 2494 - RNA, 67 nt, Artificial sequence; identical to SEQ ID NO: 2259
  Synthetic polynucleotide

SEQ ID NO: 2495 - RNA, 61 nt, Artificial sequence
  Synthetic polynucleotide
ccggcggauggcgaugggguucgccuaaucccgcauuucgggugaugacuccuaccauggg

SEQ ID NO: 2496 - RNA, 68 nt, Artificial sequence
  Synthetic polynucleotide
ccaaauacgggugauggauuuccaccuuuaaccgcucuauuuuuagagauaaugauuccuacuauagc

SEQ ID NO: 2497 - RNA, 63 nt, Artificial sequence; identical to SEQ ID NO: 2257
  Synthetic polynucleotide

SEQ ID NO: 2498 - RNA, 59 nt, Artificial sequence
  Synthetic polynucleotide
aacuaaauaggugaugacguucaccauuaaccgagagaucuaaugacggcuacuuuauc

SEQ ID NO: 2499 - RNA, 62 nt, Artificial sequence
  Synthetic polynucleotide
cguggcccaggagauggcauuccuccuugaaccgccucagcgcugaugaugccuacgcaacc

SEQ ID NO: 2500 - RNA, 75 nt, Artificial sequence
  Synthetic polynucleotide
auagauuuggggaaugaagugcucccuuguuauuaacuaaaacgcaaaaauuuugcugaugacuucuguuuuuua

SEQ ID NO: 2501 - RNA, 76 nt, Artificial sequence
  Synthetic polynucleotide
ugaagauaaggagaugguguuccuccuuuugaagaaaccgcagccguuuagcgcugcugaugacgccuacaggacc

SEQ ID NO: 2502 - RNA, 70 nt, Artificial sequence
  Synthetic polynucleotide
uuuaaaaaaggcgauggaguucgccuguaagugccucugauuuucaggggcugauaacuccuaccuuaaa

SEQ ID NO: 2503 - RNA, 63 nt, Artificial sequence
  Synthetic polynucleotide
ugcccuuagggcgauggaguccgccuuaaccgcccgcuucgggcugaugacuccuaccggguu

SEQ ID NO: 2504 - RNA, 60 nt, Artificial sequence; identical to SEQ ID NO: 2312
  Synthetic polynucleotide

SEQ ID NO: 2505 - RNA, 84 nt, Artificial sequence
  Synthetic polynucleotide
uagccaucaggugaugggguuccaccuaagcuuuugcuucaaccgcccguucuuuugaaccgugcuaauggcuccuacagaauc

SEQ ID NO: 2506 - RNA, 60 nt, Artificial sequence; identical to SEQ ID NO: 2312
  Synthetic polynucleotide

SEQ ID NO: 2507 - RNA, 67 nt, Artificial sequence; identical to SEQ ID NO: 2259
  Synthetic polynucleotide

SEQ ID NO: 2508 - RNA, 76 nt, Artificial sequence
  Synthetic polynucleotide
agggggacgggcgauggcguccgcccggggcuucgagcccgaaccgcccgcucgggcugaugacgccuguucuacc

SEQ ID NO: 2509 - RNA, 235 nt, Artificial sequence
  Synthetic polynucleotide
  misc_feature (1)..(1): N can be any nucleotide A C G or U
  misc_feature (2)..(2): N can be any nucleotide A C G or U
  misc_feature (3)..(3): N can be any nucleotide A C G or U
  misc_feature (4)..(4): N can be any nucleotide A C G or U
  misc_feature (5)..(5): N can be any nucleotide A C G or U
  misc_feature (6)..(6): N can be any nucleotide A C G or U
  misc_feature (7)..(7): N can be any nucleotide A C G or U
  misc_feature (8)..(8): N can be any nucleotide A C G or U
  misc_feature (9)..(9): N can be any nucleotide A C G or U
  misc_feature (12)..(12): N can be any nucleotide A C G or U
  misc_feature (13)..(13): R indicates a purine A or G
  misc_feature (17)..(17): R indicates a purine A or G
  misc_feature (18)..(18): N can be any nucleotide A C G or U
  misc_feature (20)..(20): R indicates a purine A or G
  misc_feature (22)..(22): Y indicates a pyrimidine C or U
  misc_feature (24)..(24): Y indicates a pyrimidine C or U
  misc_feature (25)..(25): N can be any nucleotide A C G or U
  misc_feature (28)..(28): N can be any nucleotide A C G or U
  misc_feature (29)..(29): R indicates a purine A or G
  misc_feature (30)..(30): N can be any nucleotide A C G or U
  misc_feature (31)..(31): N can be any nucleotide A C G or U
  misc_feature (32)..(32): N can be any nucleotide A C G or U
  misc_feature (33)..(33): N can be any nucleotide A C G or U
  misc_feature (34)..(34): N can be any nucleotide A C G or U
  misc_feature (35)..(35): N can be any nucleotide A C G or U
  misc_feature (41)..(41): N can be any nucleotide A C G or U
  misc_feature (42)..(42): R indicates a purine A or G
  misc_feature (43)..(43): R indicates a purine A or G
  misc_feature (44)..(44): N can be any nucleotide A C G or U
  misc_feature (45)..(45): S indicates a strong nucleotide G or C
  misc_feature (46)..(46): N can be any nucleotide A C G or U
  misc_feature (47)..(47): N can be any nucleotide A C G or U
  misc_feature (48)..(48): N can be any nucleotide A C G or U
  misc_feature (49)..(49): N can be any nucleotide A C G or U
  misc_feature (50)..(50): N can be any nucleotide A C G or U
  misc_feature (51)..(51): N can be any nucleotide A C G or U
  misc_feature (52)..(52): N can be any nucleotide A C G or U
  misc_feature (53)..(53): N can be any nucleotide A C G or U
  misc_feature (54)..(54): N can be any nucleotide A C G or U
  misc_feature (55)..(55): N can be any nucleotide A C G or U
  misc_feature (56)..(56): N can be any nucleotide A C G or U
  misc_feature (57)..(57): N can be any nucleotide A C G or U
  misc_feature (58)..(58): N can be any nucleotide A C G or U
  misc_feature (59)..(59): N can be any nucleotide A C G or U
  misc_feature (60)..(60): N can be any nucleotide A C G or U
  misc_feature (61)..(61): W indicates a weak nucleotide A or U
  misc_feature (62)..(62): N can be any nucleotide A C G or U
  misc_feature (63)..(63): N can be any nucleotide A C G or U
  misc_feature (64)..(64): N can be any nucleotide A C G or U
  misc_feature (65)..(65): N can be any nucleotide A C G or U
  misc_feature (66)..(66): N can be any nucleotide A C G or U
  misc_feature (67)..(67): N can be any nucleotide A C G or U
  misc_feature (68)..(68): N can be any nucleotide A C G or U
  misc_feature (69)..(69): M indicates an amino nucleotide A or C
  misc_feature (70)..(70): N can be any nucleotide A C G or U
  misc_feature (71)..(71): R indicates a purine A or G
  misc_feature (72)..(72): R indicates a purine A or G
  misc_feature (73)..(73): N can be any nucleotide A C G or U
  misc_feature (74)..(74): N can be any nucleotide A C G or U
  misc_feature (75)..(75): M indicates an amino nucleotide A or C
  misc_feature (78)..(78): M indicates an amino nucleotide A or C
  misc_feature (79)..(79): Y indicates a pyrimidine C or U
  misc_feature (80)..(80): R indicates a purine A or G
  misc_feature (83)..(83): M indicates an amino nucleotide A or C
  misc_feature (84)..(84): R indicates a purine A or G
  misc_feature (85)..(85): Y indicates a pyrimidine C or U
  misc_feature (86)..(86): M indicates an amino nucleotide A or C
  misc_feature (87)..(87): W indicates a weak nucleotide A or U
  misc_feature (88)..(88): R indicates a purine A or G
  misc_feature (91)..(91): S indicates a strong nucleotide G or C
  misc_feature (92)..(92): N can be any nucleotide A C G or U
  misc_feature (93)..(93): N can be any nucleotide A C G or U
  misc_feature (94)..(94): N can be any nucleotide A C G or U
  misc_feature (95)..(95): N can be any nucleotide A C G or U
  misc_feature (96)..(96): N can be any nucleotide A C G or U
  misc_feature (97)..(97): N can be any nucleotide A C G or U
  misc_feature (98)..(98): N can be any nucleotide A C G or U
  misc_feature (99)..(99): N can be any nucleotide A C G or U
  misc_feature (100)..(100): N can be any nucleotide A C G or U
  misc_feature (101)..(101): N can be any nucleotide A C G or U
  misc_feature (102)..(102): N can be any nucleotide A C G or U
  misc_feature (103)..(103): N can be any nucleotide A C G or U
  misc_feature (104)..(104): N can be any nucleotide A C G or U
  misc_feature (105)..(105): N can be any nucleotide A C G or U
  misc_feature (106)..(106): M indicates an amino nucleotide A or C
  misc_feature (107)..(107): N can be any nucleotide A C G or U
  misc_feature (108)..(108): N can be any nucleotide A C G or U
  misc_feature (109)..(109): N can be any nucleotide A C G or U
  misc_feature (110)..(110): N can be any nucleotide A C G or U
  misc_feature (111)..(111): N can be any nucleotide A C G or U
  misc_feature (112)..(112): N can be any nucleotide A C G or U
  misc_feature (113)..(113): N can be any nucleotide A C G or U
  misc_feature (114)..(114): Y indicates a pyrimidine C or U
  misc_feature (115)..(115): N can be any nucleotide A C G or U
  misc_feature (116)..(116): N can be any nucleotide A C G or U
  misc_feature (125)..(125): Y indicates a pyrimidine C or U
  misc_feature (126)..(126): N can be any nucleotide A C G or U
  misc_feature (127)..(127): N can be any nucleotide A C G or U
  misc_feature (128)..(128): N can be any nucleotide A C G or U
  misc_feature (129)..(129): N can be any nucleotide A C G or U
  misc_feature (130)..(130): N can be any nucleotide A C G or U
  misc_feature (131)..(131): N can be any nucleotide A C G or U
  misc_feature (132)..(132): N can be any nucleotide A C G or U
  misc_feature (134)..(134): N can be any nucleotide A C G or U
  misc_feature (137)..(137): N can be any nucleotide A C G or U
  misc_feature (138)..(138): N can be any nucleotide A C G or U
  misc_feature (139)..(139): N can be any nucleotide A C G or U
  misc_feature (140)..(140): N can be any nucleotide A C G or U
  misc_feature (141)..(141): N can be any nucleotide A C G or U
  misc_feature (142)..(142): N can be any nucleotide A C G or U
  misc_feature (143)..(143): N can be any nucleotide A C G or U
  misc_feature (144)..(144): N can be any nucleotide A C G or U
  misc_feature (145)..(145): N can be any nucleotide A C G or U
  misc_feature (146)..(146): N can be any nucleotide A C G or U
  misc_feature (147)..(147): N can be any nucleotide A C G or U
  misc_feature (148)..(148): N can be any nucleotide A C G or U
  misc_feature (149)..(149): N can be any nucleotide A C G or U
  misc_feature (150)..(150): N can be any nucleotide A C G or U
  misc_feature (151)..(151): N can be any nucleotide A C G or U
  misc_feature (152)..(152): N can be any nucleotide A C G or U
  misc_feature (153)..(153): N can be any nucleotide A C G or U
  misc_feature (154)..(154): N can be any nucleotide A C G or U
  misc_feature (155)..(155): W indicates a weak nucleotide A or U
  misc_feature (156)..(156): N can be any nucleotide A C G or U
  misc_feature (157)..(157): N can be any nucleotide A C G or U
  misc_feature (158)..(158): N can be any nucleotide A C G or U
  misc_feature (159)..(159): N can be any nucleotide A C G or U
  misc_feature (160)..(160): N can be any nucleotide A C G or U
  misc_feature (161)..(161): N can be any nucleotide A C G or U
  misc_feature (162)..(162): M indicates an amino nucleotide A or C
  misc_feature (163)..(163): N can be any nucleotide A C G or U
  misc_feature (164)..(164): N can be any nucleotide A C G or U
  misc_feature (166)..(166): N can be any nucleotide A C G or U
  misc_feature (167)..(167): N can be any nucleotide A C G or U
  misc_feature (168)..(168): N can be any nucleotide A C G or U
  misc_feature (169)..(169): N can be any nucleotide A C G or U
  misc_feature (170)..(170): N can be any nucleotide A C G or U
  misc_feature (171)..(171): N can be any nucleotide A C G or U
  misc_feature (172)..(172): N can be any nucleotide A C G or U
  misc_feature (173)..(173): N can be any nucleotide A C G or U
  misc_feature (174)..(174): N can be any nucleotide A C G or U
  misc_feature (175)..(175): N can be any nucleotide A C G or U
  misc_feature (176)..(176): N can be any nucleotide A C G or U
  misc_feature (177)..(177): N can be any nucleotide A C G or U
  misc_feature (178)..(178): N can be any nucleotide A C G or U
  misc_feature (179)..(179): N can be any nucleotide A C G or U
  misc_feature (180)..(180): N can be any nucleotide A C G or U
  misc_feature (181)..(181): N can be any nucleotide A C G or U
  misc_feature (182)..(182): N can be any nucleotide A C G or U
  misc_feature (183)..(183): N can be any nucleotide A C G or U
  misc_feature (184)..(184): N can be any nucleotide A C G or U
  misc_feature (185)..(185): N can be any nucleotide A C G or U
  misc_feature (186)..(186): N can be any nucleotide A C G or U
  misc_feature (187)..(187): N can be any nucleotide A C G or U
  misc_feature (188)..(188): N can be any nucleotide A C G or U
  misc_feature (189)..(189): N can be any nucleotide A C G or U
  misc_feature (190)..(190): N can be any nucleotide A C G or U
  misc_feature (191)..(191): N can be any nucleotide A C G or U
  misc_feature (192)..(192): N can be any nucleotide A C G or U
  misc_feature (195)..(195): W indicates a weak nucleotide A or U
  misc_feature (196)..(196): M indicates an amino nucleotide A or C
  misc_feature (197)..(197): N can be any nucleotide A C G or U
  misc_feature (198)..(198): N can be any nucleotide A C G or U
  misc_feature (199)..(199): N can be any nucleotide A C G or U
  misc_feature (200)..(200): N can be any nucleotide A C G or U
  misc_feature (201)..(201): N can be any nucleotide A C G or U
  misc_feature (202)..(202): N can be any nucleotide A C G or U
  misc_feature (203)..(203): N can be any nucleotide A C G or U
  misc_feature (204)..(204): N can be any nucleotide A C G or U
  misc_feature (205)..(205): N can be any nucleotide A C G or U
  misc_feature (206)..(206): N can be any nucleotide A C G or U
  misc_feature (207)..(207): N can be any nucleotide A C G or U
  misc_feature (208)..(208): N can be any nucleotide A C G or U
  misc_feature (209)..(209): N can be any nucleotide A C G or U
  misc_feature (210)..(210): N can be any nucleotide A C G or U
  misc_feature (211)..(211): N can be any nucleotide A C G or U
  misc_feature (212)..(212): N can be any nucleotide A C G or U
  misc_feature (213)..(213): N can be any nucleotide A C G or U
  misc_feature (214)..(214): R indicates a purine A or G
  misc_feature (218)..(218): R indicates a purine A or G
  misc_feature (222)..(222): R indicates a purine A or G
  misc_feature (223)..(223): Y indicates a pyrimidine C or U
  misc_feature (224)..(224): K indicates a keto nucleotide G or U
  misc_feature (225)..(225): Y indicates a pyrimidine C or U
  misc_feature (228)..(228): R indicates a purine A or G
  misc_feature (229)..(229): Y indicates a pyrimidine C or U
  misc_feature (230)..(230): N can be any nucleotide A C G or U
  misc_feature (231)..(231): N can be any nucleotide A C G or U
  misc_feature (232)..(232): N can be any nucleotide A C G or U
  misc_feature (233)..(233): N can be any nucleotide A C G or U
  misc_feature (234)..(234): N can be any nucleotide A C G or U
  misc_feature (235)..(235): N can be any nucleotide A C G or U
nnnnnnnnnggnraugrnuruycynccnrnnnnnnccaucnrrnsnnnnnnnnnnnnnnnwnnnnnnnmnrrnnmugmyrgcmrymwraasnnnnnnnnnnnnnnmnnnnnnnynnaauuccgcynnnnnnngnagnnnnnnnnnnnnnnnnnnwnnnnnnmnnannnnnnnnnnnnnnnnnnnnnnnnnnncuwmnnnnnnnnnnnnnnnnnrgcuraugrykycurynnnnnn

SEQ ID NO: 2510 - RNA, 41 nt, Artificial Sequence
  Synthetic polynucleotide
  misc_feature (1)..(1): N indicates any nucleotide A, G, C or U
  misc_feature (4)..(4): N indicates any nucleotide A, G, C or U
  misc_feature (5)..(5): R is A or G
  misc_feature (9)..(9): R is A or G
  misc_feature (10)..(10): N indicates any nucleotide A, G, C or U
  misc_feature (13)..(13): Y is C or U
  misc_feature (14)..(14): Y is C or U
  misc_feature (15)..(15): N indicates any nucleotide A, G, C or U
  misc_feature (18)..(18): N indicates any nucleotide A, G, C or U
  misc_feature (25)..(25): Y is C or U
  misc_feature (26)..(26): R is A or G
  misc_feature (36)..(36): N indicates any nucleotide A, G, C or U
  misc_feature (37)..(37): Y is C or U
  misc_feature (40)..(40): R is A or G
  misc_feature (41)..(41): Y is C or U
nggnraugrnguyynccnaaccgcyrgcugaugacnycury

SEQ ID NO: 2511 - RNA, 79 nt, Artificial Sequence
  Synthetic polynucleotide
ggaucggcgcauuggagauggcauuccuccauuaacaaacgcugcgcccguagcagcugaugaugccuacagaaaccug

SEQ ID NO: 2512 - RNA, 43 nt, Artificial sequence
  Synthetic polynucleotide
  misc_feature (1)..(1): N indicates any nucleotide A, G, C or U
  misc_feature (2)..(2): N indicates any nucleotide A, G, C or U
  misc_feature (5)..(5): N indicates any nucleotide A, G, C or U
  misc_feature (10)..(10): R is A or G
  misc_feature (11)..(11): N indicates any nucleotide A, G, C or U
  misc_feature (14)..(14): Y is C or U
  misc_feature (16)..(16): N indicates any nucleotide A, G, C or U
  misc_feature (18)..(18): N indicates any nucleotide A, G, C or U
  misc_feature (19)..(19): N indicates any nucleotide A, G, C or U
  misc_feature (20)..(20): n is a, c, g, or u
  misc_feature (26)..(26): Y is C or U
  misc_feature (27)..(27): R is A or G
  misc_feature (33)..(33): N indicates any nucleotide A, G, C or U
  misc_feature (34)..(34): Y is C or U
  misc_feature (37)..(37): R is A or G
  misc_feature (38)..(38): n is a, c, g, or u
nnggngaugrnguycnccnnaaccgcyrgcugaugacnycurc

SEQ ID NO: 2513 - RNA, 64 nt, Artificial Sequence
  Synthetic polynucleotide
  misc_feature (1)..(1): N indicates any nucleotide A, G, C or U
  misc_feature (2)..(2): N indicates any nucleotide A, G, C or U
  misc_feature (3)..(3): N indicates any nucleotide A, G, C or U
  misc_feature (4)..(4): N indicates any nucleotide A, G, C or U
  misc_feature (5)..(5): N indicates any nucleotide A, G, C or U
  misc_feature (6)..(6): N indicates any nucleotide A, G, C or U
  misc_feature (7)..(7): N indicates any nucleotide A, G, C or U
  misc_feature (8)..(8): N indicates any nucleotide A, G, C or U
  misc_feature (9)..(9): N indicates any nucleotide A, G, C or U
  misc_feature (12)..(12): N indicates any nucleotide A, G, C or U
  misc_feature (18)..(18): N indicates any nucleotide A, G, C or U
  misc_feature (21)..(21): Y is C or U
  misc_feature (23)..(23): N indicates any nucleotide A, G, C or U
  misc_feature (26)..(26): N indicates any nucleotide A, G, C or U
  misc_feature (27)..(27): N indicates any nucleotide A, G, C or U
  misc_feature (28)..(28): N indicates any nucleotide A, G, C or U
  misc_feature (35)..(35): Y is C or U
  misc_feature (36)..(36): N indicates any nucleotide A, G, C or U
  misc_feature (37)..(37): N indicates any nucleotide A, G, C or U
  misc_feature (38)..(38): N indicates any nucleotide A, G, C or U
  misc_feature (39)..(39): N indicates any nucleotide A, G, C or U
  misc_feature (40)..(40): N indicates any nucleotide A, G, C or U
  misc_feature (41)..(41): N indicates any nucleotide A, G, C or U
  misc_feature (42)..(42): N indicates any nucleotide A, G, C or U
  misc_feature (43)..(43): R is A or G
  misc_feature (53)..(53): N indicates any nucleotide A, G, C or U
  misc_feature (54)..(54): Y is C or U
  misc_feature (57)..(57): R is A or G
  misc_feature (59)..(59): N indicates any nucleotide A, G, C or U
  misc_feature (60)..(60): N indicates any nucleotide A, G, C or U
  misc_feature (61)..(61): N indicates any nucleotide A, G, C or U
  misc_feature (62)..(62): N indicates any nucleotide A, G, C or U
  misc_feature (63)..(63): N indicates any nucleotide A, G, C or U
  misc_feature (64)..(64): N indicates any nucleotide A, G, C or U
nnnnnnnnnggngauggnguycnccnnnaaccgcynnnnnnnrgcugaugacnycurcnnnnnn

SEQ ID NO: 2514 - DNA, 74 bp, Artificial Sequence; identical to SEQ ID NO: 1197
  Synthetic polynucleotide

SEQ ID NO: 2515 - DNA, 238 bp, Artificial Sequence
  Synthetic polynucleotide
cagagatctaacgccagttacagcacgcgtggcgaagggcgcgatcgaggtggccgcgccggctgggtgacgggctgccattgacgcgctgccccacccccgccatatcgtcggcaacggcaatggattcctgccgggcctcgcgccgaaccgccattgagggctgatgattcctacctgcggccgccctgcggcaaggaggaatcatgcgttcggtatttctcgtcttggtacctgc

SEQ ID NO: 2516 - DNA, 221 bp, Artificial Sequence
  Synthetic polynucleotide
cagagatctgccgacaaggccaagaagctcggcatcccggtctggaggttcggcggcgcgtaagcgccgccccgacctctaccaagagccgatctctttcgatatcatgcatggtgacggggatggagttccccgataaccgccgttccgggctgatgactcctaccaacacaggcaacccgcccgtcgatggtaggtgttcgccttcgactggtacctgc

SEQ ID NO: 2517 - DNA, 289 bp, Artificial Sequence
  Synthetic polynucleotide
cagagatcttttggccctctttcgtaagcggtgactcgaagacgccttcgcttgcctcgtactccgaaacacgattttacattttggacagacctagctaagatcggcgcattggagatggcattcctccattaacaaaccgctgcgcccgtagcagctgatgatgcctacagaaacctgatcaaaccaggtctgtaggcgttcgcgcttagaatcccttctttggtcaggcccacttattttttgtggctggccaaatgtctaaatttcgacgacctgaggtacctgc

SEQ ID NO: 2518 - DNA, 153 bp, Artificial Sequence
  Synthetic polynucleotide
tgccgacgaacgcgcatatcgtcggcaacggcaatggattcctgccgggcctcgcgccgaaccgccattgagggctgatgattcctacctgcggccgccctgcggcaaggaggaatcatgcgttcggtatttctcgtcatggtgagcaagggg

SEQ ID NO: 2519 - DNA, 136 bp, Artificial Sequence
  Synthetic polynucleotide
tgccgacgaacgcgctcatgcatggtgacggggatggagttccccgataaccgccgttccgggctgatgactcctaccaacacaggcaacccgcccgtcgatggtaggtgttcgccttcgaatggtgagcaagggg

SEQ ID NO: 2520 - DNA, 209 bp, Artificial Sequence
  Synthetic polynucleotide
tgccgacgaacgcgcaagatcggcgcattggagatggcattcctccattaacaaaccgctgcgcccgtagcagctgatgatgcctacagaaacctgatcaaaccaggtctgtaggcgttcgcgcttagaatcccttctttggtcaggcccacttattttttgtggctggccaaatgtctaaatttcgacgacctatggtgagcaagggg

SEQ ID NO: 2521 - DNA, 8 bp, Artificial Sequence
  Synthetic polynucleotide
gccatatc

SEQ ID NO: 2522 - DNA, 8 bp, Artificial Sequence
  Synthetic polynucleotide
gctatatc

SEQ ID NO: 2523 - DNA, 14 bp, Artificial Sequence
  Synthetic polynucleotide
aaggaggaatcatg

SEQ ID NO: 2524 - DNA, 18 bp, Artificial Sequence
  Synthetic polynucleotide
aaggaggaaaaacatatg

SEQ ID NO: 2525 - DNA, 63 bp, Sphingomonas sp; identical to SEQ ID NO: 618

SEQ ID NO: 2526 - DNA, 73 bp, Pseudomonas Syringae; identical to SEQ ID NO: 1392

SEQ ID NO: 2527 - DNA, 238 bp, Artificial Sequence
  Synthetic polynucleotide
cagagatctaacgccggtgacggcgcgcgtggcgaagggcgcgatcgaggtggccgcgccggctgggtgacgggctgccattgacgcgctgccccacccccgccatatcgtcggcaacggcaatggattcctgccgggcctcgcgccgaaccgccattgagggctgatgattcctacctgcggccgccctgcggcaaggaggaatcatgcgttcggtatttctcgtcttggtacctgc

The invention claimed is:

1. A $UO_2F_2$ biosensor comprising a genetically engineered bacterial cell capable of heterologously and/or natively expressing histidine kinase 1363, and U-sensitive transcriptional regulator 1362;

wherein the bacterial cell is an engineered bacterial cell including a 1362 U-sensing genetic reportable molecular component and/or a 1362 U-sensing/U-neutralizing genetic molecular component, each comprising a U-sensitive promoter in a configuration wherein the U-sensitive promoter directly initiates expression of the U-sensing reportable molecular component and/or of the U-sensing U-neutralizing molecular component in presence of bioavailable U;

wherein the U-sensitive promoter is
a 1362 U-sensitive prompter comprising a U-sensitive transcriptional 1362 binding site having a DNA sequence (SEQ ID NO: 1)
$N_1N_2N_3N_4N_5N_6N_7N_8N_9N_{10}N_{11}N_{12}N_{13}N_{14}N_{15}N_{16}N_{17}N_{18}$, in which
$N_1$ is C or T;
$N_2$ is G or A;
$N_3$ is T or C;
$N_4$ is C;
$N_5$ is A or G;
$N_6$ is G or C;
$N_7$ C or G;
$N_8$ is any nucleotide;
$N_9$ is any nucleotide;
$N_{10}$ is any nucleotide;
$N_{11}$ is any nucleotide;
$N_{12}$ is T or C;
$N_{13}$ is G;
$N_{14}$ is T or C;
$N_{15}$ is C;
$N_{16}$ is A or C;
$N_{17}$ is G; and
$N_{18}$ is C or G,
and in which $N_1$ to $N_{17}$ are selected independently
and wherein the genetically modified bacterial cell is an engineered bacterial cell further comprising an F-sensing riboswitch within at least one of
the U-sensing reportable genetic molecular component in a configuration wherein the U-sensing reportable genetic molecular component, is transcribed in presence of an effective amount of bioavailable fluoride,
an F-sensing reportable genetic molecular component in a configuration wherein the F-sensing reportable genetic molecular component is transcribed in presence of an effective amount of bioavailable fluoride, and
an F sensitive genetic circuit in which at least one molecular component is a reportable molecular component (and in particular one or more reportable genetic molecular component and/or one or more reportable cellular molecular component), the reportable molecular component expressed when the genetic circuit operates according to the circuit design in presence of bioavailable F.

2. The $UO_2F_2$ biosensor of claim 1, wherein the U-sensitive promoter further comprises a UzcR binding site having a DNA sequence:

(SEQ ID NO: 2)
$CATTACN_7N_8N_9N_{10}N_{11}N_{12}TTAA$ wherein $N_7$-$N_{12}$ is independently any nucleotide,
the UzcR binding site inserted at a location downstream of a transcription start site of the U-sensitive promoter.

3. The $UO_2F_2$ biosensor of claim 2, further comprising a UzcY gene and/or UzcZ gene inserted at a location downstream of a transcription start site of the UzcR U-sensitive promoter.

4. The $UO_2F_2$ biosensor of claim 2, wherein the bacteria are capable of natively expressing endogenous MarR family repressors such as MarR1 and/or MarR2 genes and at least one gene of the endogenous MarR family, preferably all genes of the endogenous MarR family, is knocked out.

5. The $UO_2F_2$ biosensor of claim 2, wherein the bacteria are capable of natively expressing endogenous urtAP genes and at least one gene of the endogenous urtAP, preferably all genes of the endogenous urtAP, is knocked out.

6. A $UO_2F_2$ biosensor of claim 1, wherein the F-sensing riboswitch comprises a crcB motif or an $eric^F$ motif.

7. A $UO_2F_2$ biosensor of claim 1, wherein the F-sensing riboswitch comprises a F-sensing riboswitch having sequence SEQ ID NO: 2509.

8. A $UO_2F_2$ biosensor of claim 1, wherein the F-sensing riboswitch comprises a F-sensing riboswitch having sequence SEQ ID NO: 2510 or SEQ ID NO: 2512.

9. A $UO_2F_2$ biosensor of claim 1, wherein the F-sensing riboswitch comprises a F-sensing riboswitch having sequence SEQ ID NO: 2511 or SEQ ID NO: 2513.

10. A $UO_2F_2$ biosensor of claim 1, wherein the F-sensing riboswitch comprises a F-sensing riboswitch having any one of SEQ ID NO: 205 to SEQ ID NO:1988 and from SEQ ID NO: 1999 to SEQ ID NO: 2231.

11. The $UO_2F_2$ biosensor of claim 1, wherein the F-sensing riboswitch comprises a F-sensing riboswitch *Sphingomonas* sp. MM-1, having sequence SEQ ID NO: 2514, or an F-sensing riboswitch from *Sphingomonas* sp, 67-36 having sequence SEQ ID NO: 2525, or the F-sensing riboswitch is the F-sensing riboswitch from *Pseudomonas Syringae* having sequence SEQ ID NO: 2526.

12. A $UO_2F_2$ biosensor of claim 1, wherein the bacterial cell comprises an endogenous F-sensing riboswitch and the endogenous F-sensing riboswitch is knocked out.

13. The $UO_2F_2$ biosensor of claim 1, wherein in the sequence SEQ ID NO:1:
$N_1$ is C; and/or
$N_2$ is G; and/or
$N_3$ is T; and/or
$N_5$ is A; and/or
$N_6$ is G; and/or
$N_{14}$ is T; and/or
$N_{16}$ is A.

14. The $UO_2F_2$ biosensor of claim 1, wherein the U-sensitive transcriptional 1362 binding site has a sequence selected from the group consisting of SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26 and SEQ ID NO:27.

15. The $UO_2F_2$ biosensor of claim 1, wherein the U-sensitive promoter further comprises nucleotides $N_{19}N_{20}N_{21}$, downstream of SEQ ID NO: 1 wherein $N_{19}$ is any nucleotide; $N_{20}$ is any nucleotide; and $N_{21}$ is G (SEQ ID NO: 83).

16. The $UO_2F_2$ biosensor of claim 15, wherein $N_{18}$ of the regulator direct repeat is located about −17 to about −40 upstream of a transcription start site.

17. The $UO_2F_2$ biosensor of claim 1, wherein the U-sensitive promoter is P1361 or Pphyt.

18. The $UO_2F_2$ biosensor of claim 1, wherein biosensor comprises, the F-sensing reportable genetic molecular component and the 1362 F-sensing genetic reportable molecular component and/or a 1362 U-sensing/U-neutralizing genetic molecular component, and the F-sensing reportable genetic molecular component are operatively connected to a same or a different reportable molecular component in U-sensing genetic circuit.

19. The $UO_2F_2$ biosensor of claim 15, wherein
the cell is further natively and/or heterologously expressing histidine kinase UzcS, and response regulator UzcS, and
the U-sensing genetic circuit further comprises a UzcR U-sensing genetic reportable molecular component and/or a UzcR U-sensing/U-neutralizing genetic molecular component, each comprising a UzcR U-sensitive promoter in a configuration wherein the U-sensitive promoter directly initiates expression of the U-sensing reportable molecular component and/or of the U-sensing U-neutralizing molecular component in presence of bioavailable U,
the UzcR U sensitive promoter comprising a UzcR binding site having DNA sequence:

(SEQ ID NO: 2)
CATTAC$N_7N_8N_9N_{10}N_{11}N_{12}$TTAA wherein $N_7$-$N_{12}$ is independently any nucleotide, and in some embodiments any one of $N_7$-$N_{11}$ can independently be A.

20. The $UO_2F_2$ biosensor of claim 18, wherein the U-sensitive genetic circuit comprises one or more AND gates.

21. The $UO_2F_2$ biosensor of claim 20, wherein at least one of the AND gates is an in-series AND gate.

22. The $UO_2F_2$ biosensor of claim 20, wherein at least one of the AND gates is an in-parallel AND gate.

23. The $UO_2F_2$ biosensor of claim 20, wherein two or more in series AND gates and/or in parallel AND gates are connected by activating, inhibiting, binding, or converting reactions.

24. The $UO_2F_2$ biosensor of claim 20, wherein at least one of the AND gates is selected from the group consisting of an HRP AND gate, a bacterial two-hybrid AND gate, a tripartite GFP AND gate, and a FRET sensor AND gate.

25. The $UO_2F_2$ biosensor of claim 1, wherein the $UO_2F_2$ biosensor is configured to detect and/or neutralize bioavailable U present in a target environment at a concentration of 100 nM or greater, between 100 nM and 1 µM, or greater than 1 µM.

26. The method of claim 1, wherein the $UO_2F_2$ biosensor is configured to detect bioavailable F present in a target environment at a concentration 10 µM or greater, between 50 µM and 60 µM, greater than 1 nanomolar, and between 100 nanomolar and 1 mM.

27. The $UO_2F_2$ biosensor of claim 1, wherein the reportable molecular component is capable of being detected using fluorescence, luminescence, chemiluminescence, colorimetric analysis, radioactivity, or electrical signal.

28. The $UO_2F_2$ biosensor of claim 1, wherein the U-neutralizing molecular component is configured to decrease or eliminate toxicity of U by bioreduction, biomineralization, bioaccumulation, and/or biosorption.

29. The $UO_2F_2$ biosensor of claim 1, wherein the bacterial cell is a proteobacterial cell.

30. The $UO_2F_2$ biosensor of claim 29, wherein the proteobacterial cell is an alphaproteobacteria, a betaproteobacteria, or a gam maproteobacteria.

31. The $UO_2F_2$ biosensor of claim 29, wherein the proteobacterial cell is a Caulobacteridae cell.

32. The $UO_2F_2$ biosensor of claim 29, wherein the proteobacterial cell is a *Caulobacter crescentus* cell.

33. The $UO_2F_2$ biosensor of claim 32, wherein the *Caulobacter crescentus* cell is a member of a strain selected from the group consisting of NA1000, CB15, and OR37.

34. A $UO_2F_2$-sensing system comprising:
One or more of the $UO_2F_2$ biosensors of claim 1 operatively connected to an electronic signal transducer adapted to convert a $UO_2F_2$ biosensor reportable molecular component output into an electronic output.

35. A method of detecting and reporting and/or neutralizing bioavailable U, the method comprising:
contacting one or more of the $UO_2F_2$ biosensors of claim 1, with a target environment comprising one or more target ranges of U concentration, the contacting performed for a time and under conditions to detect and report and/or neutralize bioavailable U in the target environment.

36. A $UO_2F_2$-sensing genetic reportable component comprising:
one or more U sensitive promoters comprising a U-sensitive 1362 binding site having a DNA sequence (SEQ ID NO: 1)
$N_1N_2N_3N_4N_5N_6N_7N_8N_9N_{10}N_{11}N_{12}N_{13}N_{14}N_{15}N_{16}N_{17}N_{18}$, in which
$N_1$ is C or T;
$N_2$ is G or A;
$N_3$ is T or C;
$N_4$ is C;
$N_5$ is A or G;
$N_6$ is G or C;
$N_7$ C or G;
$N_8$ is any nucleotide;
$N_9$ is any nucleotide;
$N_{10}$ is any nucleotide;
$N_{11}$ is any nucleotide;
$N_{12}$ is T or C;
$N_{13}$ is G;
$N_{14}$ is T or C;
$N_{15}$ is C;
$N_{16}$ is A or C;
$N_{17}$ is G; and
$N_{18}$ is C or G,
and in which $N_1$ to $N_{17}$ are selected independently
together with
a U-sensing reportable molecular component,
wherein at least one of the one or more U-sensitive promoters and the U-sensing reportable molecular component, comprises an F-sensing riboswitch in a single output configuration wherein the U-sensing reportable genetic molecular component, is transcribed in presence of an effective amount of bioavailable fluoride,
and wherein the one or more U sensitive promoters and the U-sensing reportable molecular component are in a configuration wherein the one or more U sensitive promoters directly initiate expression of the U-sensing reportable molecular component in presence of bioavailable U and bioavailable Fluoride.

37. $UO_2F_2$-sensing genetic reportable component of claim 36, wherein the one or more U sensitive promoters comprise a U sensitive UzcR binding site, having a DNA sequence:

(SEQ ID NO: 2)
CATTAC$N_7N_8N_9N_{10}N_{11}N_{12}$TTAA wherein $N_7$-$N_{12}$ is independently any nucleotide.

38. A $UO_2F_2$-sensing genetic reportable component of claim 36, wherein the one or more U-sensitive promoters and the U-sensing reportable molecular component are configured to provide a $UO_2F_2$-sensing gene cassette and wherein the $UO_2F_2$-sensing gene cassette is an expression cassette.

39. A $UO_2F_2$-sensing genetic reportable component of claim 38, wherein the $UO_2F_2$-sensing gene cassette is comprised within a vector.

40. The $UO_2F_2$-sensing genetic reportable component of claim 36, wherein
$N_1$ is C; and/or
$N_2$ is G; and/or
$N_3$ is T; and/or
$N_5$ is A; and/or
$N_6$ is G; and/or
$N_{14}$ is T; and/or
$N_{16}$ is A.

* * * * *